United States Patent 12,097,253 (RSV RNA MOLECULES AND COMPOSITIONS FOR VACCINATION) - sequence listing, part 7

SEQ ID NO: 7939 - RNA, 1921 nt, synthetic construct
  misc_feature 1..1921: note = mRNA product Design a-3 comprising derived and/or modified sequence from HRSV(A2)__F-del_DSCav1_mut8 (opt5)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7940 - RNA, 1921 nt, synthetic construct
  misc_feature 1..1921: note = mRNA product Design a-3 comprising derived and/or modified sequence from HRSV(A2)__F-del_DSCav1_mut8 (opt6)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7941 - RNA, 1921 nt, synthetic construct
  misc_feature 1..1921: note = mRNA product Design a-3 comprising derived and/or modified sequence from HRSV(A2)__F-del_DSCav1_mut8 (opt11)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7942 - RNA, 1870 nt, synthetic construct
  misc_feature 1..1870: note = mRNA product Design a-4 comprising derived and/or modified sequence from HRSV(A2)__F-del_DSCav1_mut8 (opt1)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7943 - RNA, 1870 nt, synthetic construct
  misc_feature 1..1870: note = mRNA product Design a-4 comprising derived and/or modified sequence from HRSV(A2)__F-del_DSCav1_mut8 (opt1)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7944 - RNA, 1870 nt, synthetic construct
  misc_feature 1..1870: note = mRNA product Design a-4 comprising derived and/or modified sequence from HRSV(A2)__F-del_DSCav1_mut8 (opt2)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7945 - RNA, 1870 nt, synthetic construct
  misc_feature 1..1870: note = mRNA product Design a-4 comprising derived and/or modified sequence from HRSV(A2)__F-del_DSCav1_mut8 (opt3)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7946 - RNA, 1870 nt, synthetic construct
  misc_feature 1..1870: note = mRNA product Design a-4 comprising derived and/or modified sequence from HRSV(A2)__F-del_DSCav1_mut8 (opt4)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7947 - RNA, 1870 nt, synthetic construct
  misc_feature 1..1870: note = mRNA product Design a-4 comprising derived and/or modified sequence from HRSV(A2)__F-del_DSCav1_mut8 (opt5)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7948 - RNA, 1870 nt, synthetic construct
  misc_feature 1..1870: note = mRNA product Design a-4 comprising derived and/or modified sequence from HRSV(A2)__F-del_DSCav1_mut8 (opt6)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7949 - RNA, 1870 nt, synthetic construct
  misc_feature 1..1870: note = mRNA product Design a-4 comprising derived and/or modified sequence from HRSV(A2)__F-del_DSCav1_mut8 (opt11)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7950 - RNA, 1816 nt, synthetic construct
  misc_feature 1..1816: note = mRNA product Design a-5 comprising derived and/or modified sequence from HRSV(A2)__F-del_DSCav1_mut8 (opt1)
  source 1..1816: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7951 - RNA, 1816 nt, synthetic construct
  misc_feature 1..1816: note = mRNA product Design a-5 comprising derived and/or modified sequence from HRSV(A2)__F-del_DSCav1_mut8 (opt1)
  source 1..1816: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7952 - RNA, 1816 nt, synthetic construct
  misc_feature 1..1816: note = mRNA product Design a-5 comprising derived and/or modified sequence from HRSV(A2)__F-del_DSCav1_mut8 (opt2)
  source 1..1816: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7953 - RNA, 1816 nt, synthetic construct
  misc_feature 1..1816: note = mRNA product Design a-5 comprising derived and/or modified sequence from HRSV(A2)__F-del_DSCav1_mut8 (opt3)
  source 1..1816: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7954 - RNA, 1816 nt, synthetic construct
  misc_feature 1..1816: note = mRNA product Design a-5 comprising derived and/or modified sequence from HRSV(A2)__F-del_DSCav1_mut8 (opt4)
  source 1..1816: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7955 - RNA, 1816 nt, synthetic construct
  misc_feature 1..1816: note = mRNA product Design a-5 comprising derived and/or modified sequence from HRSV(A2)__F-del_DSCav1_mut8 (opt5)
  source 1..1816: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7956 - RNA, 1816 nt, synthetic construct
  misc_feature 1..1816: note = mRNA product Design a-5 comprising derived and/or modified sequence from HRSV(A2)__F-del_DSCav1_mut8 (opt6)
  source 1..1816: mol_type = other RNA
gggagactttcccattctgtagcagaatttggtgttgcctgtggtcttggtcccgcggagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7957 - RNA, 1816 nt, synthetic construct
  misc_feature 1..1816: note = mRNA product Design a-5 comprising derived and/or modified sequence from HRSV(A2)__F-del_DSCav1_mut8 (opt11)
  source 1..1816: mol_type = other RNA
gggagactttcccattctgtagcagaatttggtgttgcctgtggtcttggtcccgcggagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7958 - RNA, 1997 nt, synthetic construct
  misc_feature 1..1997: note = mRNA product Design b-1 comprising derived and/or modified sequence from HRSV(A2)__F-del_DSCav1_mut8 (opt1)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7959 - RNA, 1997 nt, synthetic construct
  misc_feature 1..1997: note = mRNA product Design b-1 comprising derived and/or modified sequence from HRSV(A2)__F-del_DSCav1_mut8 (opt1)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7960 - RNA, 1997 nt, synthetic construct
  misc_feature 1..1997: note = mRNA product Design b-1 comprising derived and/or modified sequence from HRSV(A2)__F-del_DSCav1_mut8 (opt2)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7961 - RNA, 1997 nt, synthetic construct
  misc_feature 1..1997: note = mRNA product Design b-1 comprising derived and/or modified sequence from HRSV(A2)__F-del_DSCav1_mut8 (opt3)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7962 - RNA, 1997 nt, synthetic construct
  misc_feature 1..1997: note = mRNA product Design b-1 comprising derived and/or modified sequence from HRSV(A2)__F-del_DSCav1_mut8 (opt4)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7963 - RNA, 1997 nt, synthetic construct
  misc_feature 1..1997: note = mRNA product Design b-1 comprising derived and/or modified sequence from HRSV(A2)__F-del_DSCav1_mut8 (opt5)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7964 - RNA, 1997 nt, synthetic construct
  misc_feature 1..1997: note = mRNA product Design b-1 comprising derived and/or modified sequence from HRSV(A2)__F-del_DSCav1_mut8 (opt6)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7965 - RNA, 1997 nt, synthetic construct
  misc_feature 1..1997: note = mRNA product Design b-1 comprising derived and/or modified sequence from HRSV(A2)__F-del_DSCav1_mut8 (opt11)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7966 - RNA, 1817 nt, synthetic construct
  misc_feature 1..1817: note = mRNA product Design b-2 comprising derived and/or modified sequence from HRSV(A2)__F-del_DSCav1_mut8 (opt1)
  source 1..1817: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7967 - RNA, 1817 nt, synthetic construct
  misc_feature 1..1817: note = mRNA product Design b-2 comprising derived and/or modified sequence from HRSV(A2)__F-del_DSCav1_mut8 (opt1)
  source 1..1817: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7968 - RNA, 1817 nt, synthetic construct
  misc_feature 1..1817: note = mRNA product Design b-2 comprising derived and/or modified sequence from HRSV(A2)__F-del_DSCav1_mut8 (opt2)
  source 1..1817: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7969 - RNA, 1817 nt, synthetic construct
  misc_feature 1..1817: note = mRNA product Design b-2 comprising derived and/or modified sequence from HRSV(A2)__F-del_DSCav1_mut8 (opt3)
  source 1..1817: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7970 - RNA, 1817 nt, synthetic construct
  misc_feature 1..1817: note = mRNA product Design b-2 comprising derived and/or modified sequence from HRSV(A2)__F-del_DSCav1_mut8 (opt4)
  source 1..1817: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7971 - RNA, 1817 nt, synthetic construct
  misc_feature 1..1817: note = mRNA product Design b-2 comprising derived and/or modified sequence from HRSV(A2)__F-del_DSCav1_mut8 (opt5)
  source 1..1817: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7972 - RNA, 1817 nt, synthetic construct
  misc_feature 1..1817: note = mRNA product Design b-2 comprising derived and/or modified sequence from HRSV(A2)__F-del_DSCav1_mut8 (opt6)
  source 1..1817: mol_type = other RNA
gggagagcctctgctggagtccggggagtggcgttggctgctagagcgaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7973 - RNA, 1817 nt, synthetic construct
  misc_feature 1..1817: note = mRNA product Design b-2 comprising derived and/or modified sequence from HRSV(A2)__F-del_DSCav1_mut8 (opt11)
  source 1..1817: mol_type = other RNA
gggagagcctctgctggagtccggggagtggcgttggctgctagagcgaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7974 - RNA, 1837 nt, synthetic construct
  misc_feature 1..1837: note = mRNA product Design b-3 comprising derived and/or modified sequence from HRSV(A2)__F-del_DSCav1_mut8 (opt1)
  source 1..1837: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7975 - RNA, 1837 nt, synthetic construct
  misc_feature 1..1837: note = mRNA product Design b-3 comprising derived and/or modified sequence from HRSV(A2)__F-del_DSCav1_mut8 (opt1)
  source 1..1837: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7976 - RNA, 1837 nt, synthetic construct
  misc_feature 1..1837: note = mRNA product Design b-3 comprising derived and/or modified sequence from HRSV(A2)__F-del_DSCav1_mut8 (opt2)
  source 1..1837: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7977 - RNA, 1837 nt, synthetic construct
  misc_feature 1..1837: note = mRNA product Design b-3 comprising derived and/or modified sequence from HRSV(A2)__F-del_DSCav1_mut8 (opt3)
  source 1..1837: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7978 - RNA, 1837 nt, synthetic construct
  misc_feature 1..1837: note = mRNA product Design b-3 comprising derived and/or modified sequence from HRSV(A2)__F-del_DSCav1_mut8 (opt4)
  source 1..1837: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7979 - RNA, 1837 nt, synthetic construct
  misc_feature 1..1837: note = mRNA product Design b-3 comprising derived and/or modified sequence from HRSV(A2)__F-del_DSCav1_mut8 (opt5)
  source 1..1837: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7980 - RNA, 1837 nt, synthetic construct
  misc_feature 1..1837: note = mRNA product Design b-3 comprising derived and/or modified sequence from HRSV(A2)__F-del_DSCav1_mut8 (opt6)
  source 1..1837: mol_type = other RNA
gggagagtcccgcagtcggcgtccagcggctctgcttgttcgtgtgtgtgtcgttgcaggccttattcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7981 - RNA, 1837 nt, synthetic construct
  misc_feature 1..1837: note = mRNA product Design b-3 comprising derived and/or modified sequence from HRSV(A2)__F-del_DSCav1_mut8 (opt11)
  source 1..1837: mol_type = other RNA
gggagagtcccgcagtcggcgtccagcggctctgcttgttcgtgtgtgtgtcgttgcaggccttattcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7982 - RNA, 1888 nt, synthetic construct
  misc_feature 1..1888: note = mRNA product Design b-4 comprising derived and/or modified sequence from HRSV(A2)__F-del_DSCav1_mut8 (opt1)
  source 1..1888: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7983 - RNA, 1888 nt, synthetic construct
  misc_feature 1..1888: note = mRNA product Design b-4 comprising derived and/or modified sequence from HRSV(A2)__F-del_DSCav1_mut8 (opt1)
  source 1..1888: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7984 - RNA, 1888 nt, synthetic construct
  misc_feature 1..1888: note = mRNA product Design b-4 comprising derived and/or modified sequence from HRSV(A2)__F-del_DSCav1_mut8 (opt2)
  source 1..1888: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7985 - RNA, 1888 nt, synthetic construct
  misc_feature 1..1888: note = mRNA product Design b-4 comprising derived and/or modified sequence from HRSV(A2)__F-del_DSCav1_mut8 (opt3)
  source 1..1888: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7986 - RNA, 1888 nt, synthetic construct
  misc_feature 1..1888: note = mRNA product Design b-4 comprising derived and/or modified sequence from HRSV(A2)__F-del_DSCav1_mut8 (opt4)
  source 1..1888: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7987 - RNA, 1888 nt, synthetic construct
  misc_feature 1..1888: note = mRNA product Design b-4 comprising derived and/or modified sequence from HRSV(A2)__F-del_DSCav1_mut8 (opt5)
  source 1..1888: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7988 - RNA, 1888 nt, synthetic construct
  misc_feature 1..1888: note = mRNA product Design b-4 comprising derived and/or modified sequence from HRSV(A2)__F-del_DSCav1_mut8 (opt6)
  source 1..1888: mol_type = other RNA
gggagagtcccgcagtcggcgtccagcggctctgcttgttcgtgtgtgtgtcgttgcaggccttattcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7989 - RNA, 1888 nt, synthetic construct
  misc_feature 1..1888: note = mRNA product Design b-4 comprising derived and/or modified sequence from HRSV(A2)__F-del_DSCav1_mut8 (opt11)
  source 1..1888: mol_type = other RNA
gggagagtcccgcagtcggcgtccagcggctctgcttgttcgtgtgtgtgtcgttgcaggccttattcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7990 - RNA, 1950 nt, synthetic construct
  misc_feature 1..1950: note = mRNA product Design b-5 comprising derived and/or modified sequence from HRSV(A2)__F-del_DSCav1_mut8 (opt1)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7991 - RNA, 1950 nt, synthetic construct
  misc_feature 1..1950: note = mRNA product Design b-5 comprising derived and/or modified sequence from HRSV(A2)__F-del_DSCav1_mut8 (opt1)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7992 - RNA, 1950 nt, synthetic construct
  misc_feature 1..1950: note = mRNA product Design b-5 comprising derived and/or modified sequence from HRSV(A2)__F-del_DSCav1_mut8 (opt2)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7993 - RNA, 1950 nt, synthetic construct
  misc_feature 1..1950: note = mRNA product Design b-5 comprising derived and/or modified sequence from HRSV(A2)__F-del_DSCav1_mut8 (opt3)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7994 - RNA, 1950 nt, synthetic construct
  misc_feature 1..1950: note = mRNA product Design b-5 comprising derived and/or modified sequence from HRSV(A2)__F-del_DSCav1_mut8 (opt4)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7995 - RNA, 1950 nt, synthetic construct
  misc_feature 1..1950: note = mRNA product Design b-5 comprising derived and/or modified sequence from HRSV(A2)__F-del_DSCav1_mut8 (opt5)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7996 - RNA, 1950 nt, synthetic construct
  misc_feature 1..1950: note = mRNA product Design b-5 comprising derived and/or modified sequence from HRSV(A2)__F-del_DSCav1_mut8 (opt6)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7997 - RNA, 1950 nt, synthetic construct
  misc_feature 1..1950: note = mRNA product Design b-5 comprising derived and/or modified sequence from HRSV(A2)__F-del_DSCav1_mut8 (opt11)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7998 - RNA, 1856 nt, synthetic construct
  misc_feature 1..1856: note = mRNA product Design c-1 comprising derived and/or modified sequence from HRSV(A2)__F-del_DSCav1_mut8 (opt1)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7999 - RNA, 1856 nt, synthetic construct
  misc_feature 1..1856: note = mRNA product Design c-1 comprising derived and/or modified sequence from HRSV(A2)__F-del_DSCav1_mut8 (opt1)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8000 - RNA, 1856 nt, synthetic construct
  misc_feature 1..1856: note = mRNA product Design c-1 comprising derived and/or modified sequence from HRSV(A2)__F-del_DSCav1_mut8 (opt2)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8001 - RNA, 1856 nt, synthetic construct
  misc_feature 1..1856: note = mRNA product Design c-1 comprising derived and/or modified sequence from HRSV(A2)__F-del_DSCav1_mut8 (opt3)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8002 - RNA, 1856 nt, synthetic construct
  misc_feature 1..1856: note = mRNA product Design c-1 comprising derived and/or modified sequence from HRSV(A2)__F-del_DSCav1_mut8 (opt4)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8003 - RNA, 1856 nt, synthetic construct
  misc_feature 1..1856: note = mRNA product Design c-1 comprising derived and/or modified sequence from HRSV(A2)__F-del_DSCav1_mut8 (opt5)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8004 - RNA, 1856 nt, synthetic construct
  misc_feature 1..1856: note = mRNA product Design c-1 comprising derived and/or modified sequence from HRSV(A2)__F-del_DSCav1_mut8 (opt6)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8005 - RNA, 1856 nt, synthetic construct
  misc_feature 1..1856: note = mRNA product Design c-1 comprising derived and/or modified sequence from HRSV(A2)__F-del_DSCav1_mut8 (opt11)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8006 - RNA, 1946 nt, synthetic construct
  misc_feature 1..1946: note = mRNA product Design c-2 comprising derived and/or modified sequence from HRSV(A2)__F-del_DSCav1_mut8 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8007 - RNA, 1946 nt, synthetic construct
  misc_feature 1..1946: note = mRNA product Design c-2 comprising derived and/or modified sequence from HRSV(A2)__F-del_DSCav1_mut8 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8008 - RNA, 1946 nt, synthetic construct
  misc_feature 1..1946: note = mRNA product Design c-2 comprising derived and/or modified sequence from HRSV(A2)__F-del_DSCav1_mut8 (opt2)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8009 - RNA, 1946 nt, synthetic construct
  misc_feature 1..1946: note = mRNA product Design c-2 comprising derived and/or modified sequence from HRSV(A2)__F-del_DSCav1_mut8 (opt3)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8010 - RNA, 1946 nt, synthetic construct
  misc_feature 1..1946: note = mRNA product Design c-2 comprising derived and/or modified sequence from HRSV(A2)__F-del_DSCav1_mut8 (opt4)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8011 - RNA, 1946 nt, synthetic construct
  misc_feature 1..1946: note = mRNA product Design c-2 comprising derived and/or modified sequence from HRSV(A2)__F-del_DSCav1_mut8 (opt5)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8012 - RNA, 1946 nt, synthetic construct
  misc_feature 1..1946: note = mRNA product Design c-2 comprising derived and/or modified sequence from HRSV(A2)__F-del_DSCav1_mut8 (opt6)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8013 - RNA, 1946 nt, synthetic construct
  misc_feature 1..1946: note = mRNA product Design c-2 comprising derived and/or modified sequence from HRSV(A2)__F-del_DSCav1_mut8 (opt11)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8014 - RNA, 1923 nt, synthetic construct
  misc_feature 1..1923: note = mRNA product Design c-3 comprising derived and/or modified sequence from HRSV(A2)__F-del_DSCav1_mut8 (opt1)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8015 - RNA, 1923 nt, synthetic construct
  misc_feature 1..1923: note = mRNA product Design c-3 comprising derived and/or modified sequence from HRSV(A2)__F-del_DSCav1_mut8 (opt1)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8016 - RNA, 1923 nt, synthetic construct
  misc_feature 1..1923: note = mRNA product Design c-3 comprising derived and/or modified sequence from HRSV(A2)__F-del_DSCav1_mut8 (opt2)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8017 - RNA, 1923 nt, synthetic construct
  misc_feature 1..1923: note = mRNA product Design c-3 comprising derived and/or modified sequence from HRSV(A2)__F-del_DSCav1_mut8 (opt3)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8018 - RNA, 1923 nt, synthetic construct
  misc_feature 1..1923: note = mRNA product Design c-3 comprising derived and/or modified sequence from HRSV(A2)__F-del_DSCav1_mut8 (opt4)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8019 - RNA, 1923 nt, synthetic construct
  misc_feature 1..1923: note = mRNA product Design c-3 comprising derived and/or modified sequence from HRSV(A2)__F-del_DSCav1_mut8 (opt5)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8020 - RNA, 1923 nt, synthetic construct
  misc_feature 1..1923: note = mRNA product Design c-3 comprising derived and/or modified sequence from HRSV(A2)__F-del_DSCav1_mut8 (opt6)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8021 - RNA, 1923 nt, synthetic construct
  misc_feature 1..1923: note = mRNA product Design c-3 comprising derived and/or modified sequence from HRSV(A2)__F-del_DSCav1_mut8 (opt11)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8022 - RNA, 1919 nt, synthetic construct
  misc_feature 1..1919: note = mRNA product Design c-4 comprising derived and/or modified sequence from HRSV(A2)__F-del_DSCav1_mut8 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8023 - RNA, 1919 nt, synthetic construct
  misc_feature 1..1919: note = mRNA product Design c-4 comprising derived and/or modified sequence from HRSV(A2)__F-del_DSCav1_mut8 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8024 - RNA, 1919 nt, synthetic construct
  misc_feature 1..1919: note = mRNA product Design c-4 comprising derived and/or modified sequence from HRSV(A2)__F-del_DSCav1_mut8 (opt2)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8025 - RNA, 1919 nt, synthetic construct
  misc_feature 1..1919: note = mRNA product Design c-4 comprising derived and/or modified sequence from HRSV(A2)__F-del_DSCav1_mut8 (opt3)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8026 - RNA, 1919 nt, synthetic construct
  misc_feature 1..1919: note = mRNA product Design c-4 comprising derived and/or modified sequence from HRSV(A2)__F-del_DSCav1_mut8 (opt4)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8027 - RNA, 1919 nt, synthetic construct
  misc_feature 1..1919: note = mRNA product Design c-4 comprising derived and/or modified sequence from HRSV(A2)__F-del_DSCav1_mut8 (opt5)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8028 - RNA, 1919 nt, synthetic construct
  misc_feature 1..1919: note = mRNA product Design c-4 comprising derived and/or modified sequence from HRSV(A2)__F-del_DSCav1_mut8 (opt6)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8029 - RNA, 1919 nt, synthetic construct
  misc_feature 1..1919: note = mRNA product Design c-4 comprising derived and/or modified sequence from HRSV(A2)__F-del_DSCav1_mut8 (opt11)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8030 - RNA, 1837 nt, synthetic construct
  misc_feature 1..1837: note = mRNA product Design c-5 comprising derived and/or modified sequence from HRSV(A2)__F-del_DSCav1_mut8 (opt1)
  source 1..1837: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8031 - RNA, 1837 nt, synthetic construct
  misc_feature 1..1837: note = mRNA product Design c-5 comprising derived and/or modified sequence from HRSV(A2)__F-del_DSCav1_mut8 (opt1)
  source 1..1837: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8032 - RNA, 1837 nt, synthetic construct
  misc_feature 1..1837: note = mRNA product Design c-5 comprising derived and/or modified sequence from HRSV(A2)__F-del_DSCav1_mut8 (opt2)
  source 1..1837: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8033 - RNA, 1837 nt, synthetic construct
  misc_feature 1..1837: note = mRNA product Design c-5 comprising derived and/or modified sequence from HRSV(A2)__F-del_DSCav1_mut8 (opt3)
  source 1..1837: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8034 - RNA, 1837 nt, synthetic construct
  misc_feature 1..1837: note = mRNA product Design c-5 comprising derived and/or modified sequence from HRSV(A2)__F-del_DSCav1_mut8 (opt4)
  source 1..1837: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8035 - RNA, 1837 nt, synthetic construct
  misc_feature 1..1837: note = mRNA product Design c-5 comprising derived and/or modified sequence from HRSV(A2)__F-del_DSCav1_mut8 (opt5)
  source 1..1837: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8036 - RNA, 1837 nt, synthetic construct
  misc_feature 1..1837: note = mRNA product Design c-5 comprising derived and/or modified sequence from HRSV(A2)__F-del_DSCav1_mut8 (opt6)
  source 1..1837: mol_type = other RNA
gggagagcggctcggccattttgtcccagtcagtccggaggctgcggctgcagaagtaccgcctgcggagtaactgcaaagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8037 - RNA, 1837 nt, synthetic construct
  misc_feature 1..1837: note = mRNA product Design c-5 comprising derived and/or modified sequence from HRSV(A2)__F-del_DSCav1_mut8 (opt11)
  source 1..1837: mol_type = other RNA
gggagagcggctcggccattttgtcccagtcagtccggaggctgcggctgcagaagtaccgcctgcggagtaactgcaaagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8038 - RNA, 1846 nt, synthetic construct
  misc_feature 1..1846: note = mRNA product Design d-1 comprising derived and/or modified sequence from HRSV(A2)__F-del_DSCav1_mut8 (opt1)
  source 1..1846: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8039 - RNA, 1846 nt, synthetic construct
  misc_feature 1..1846: note = mRNA product Design d-1 comprising derived and/or modified sequence from HRSV(A2)__F-del_DSCav1_mut8 (opt1)
  source 1..1846: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8040 - RNA, 1846 nt, synthetic construct
  misc_feature 1..1846: note = mRNA product Design d-1 comprising derived and/or modified sequence from HRSV(A2)__F-del_DSCav1_mut8 (opt2)
  source 1..1846: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8041 - RNA, 1846 nt, synthetic construct
  misc_feature 1..1846: note = mRNA product Design d-1 comprising derived and/or modified sequence from HRSV(A2)__F-del_DSCav1_mut8 (opt3)
  source 1..1846: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8042 - RNA, 1846 nt, synthetic construct
  misc_feature 1..1846: note = mRNA product Design d-1 comprising derived and/or modified sequence from HRSV(A2)__F-del_DSCav1_mut8 (opt4)
  source 1..1846: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8043 - RNA, 1846 nt, synthetic construct
  misc_feature 1..1846: note = mRNA product Design d-1 comprising derived and/or modified sequence from HRSV(A2)__F-del_DSCav1_mut8 (opt5)
  source 1..1846: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8044 - RNA, 1846 nt, synthetic construct
  misc_feature 1..1846: note = mRNA product Design d-1 comprising derived and/or modified sequence from HRSV(A2)__F-del_DSCav1_mut8 (opt6)
  source 1..1846: mol_type = other RNA
gggagacccgtgacccggaagttgtacggctacgcgactttccctcccacaaaccctcgcgcccttcctttcctacttgggcccggcagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8045 - RNA, 1846 nt, synthetic construct
  misc_feature 1..1846: note = mRNA product Design d-1 comprising derived and/or modified sequence from HRSV(A2)__F-del_DSCav1_mut8 (opt11)
  source 1..1846: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8046 - RNA, 1901 nt, synthetic construct
  misc_feature 1..1901: note = mRNA product Design d-2 comprising derived and/or modified sequence from HRSV(A2)__F-del_DSCav1_mut8 (opt1)
  source 1..1901: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8047 - RNA, 1901 nt, synthetic construct
  misc_feature 1..1901: note = mRNA product Design d-2 comprising derived and/or modified sequence from HRSV(A2)__F-del_DSCav1_mut8 (opt1)
  source 1..1901: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8048 - RNA, 1901 nt, synthetic construct
  misc_feature 1..1901: note = mRNA product Design d-2 comprising derived and/or modified sequence from HRSV(A2)__F-del_DSCav1_mut8 (opt2)
  source 1..1901: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8049 - RNA, 1901 nt, synthetic construct
  misc_feature 1..1901: note = mRNA product Design d-2 comprising derived and/or modified sequence from HRSV(A2)__F-del_DSCav1_mut8 (opt3)
  source 1..1901: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8050 - RNA, 1901 nt, synthetic construct
  misc_feature 1..1901: note = mRNA product Design d-2 comprising derived and/or modified sequence from HRSV(A2)__F-del_DSCav1_mut8 (opt4)
  source 1..1901: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8051 - RNA, 1901 nt, synthetic construct
  misc_feature 1..1901: note = mRNA product Design d-2 comprising derived and/or modified sequence from HRSV(A2)__F-del_DSCav1_mut8 (opt5)
  source 1..1901: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8052 - RNA, 1901 nt, synthetic construct
  misc_feature 1..1901: note = mRNA product Design d-2 comprising derived and/or modified sequence from HRSV(A2)__F-del_DSCav1_mut8 (opt6)
  source 1..1901: mol_type = other RNA
gggagagcggctcggccattttgtcccagtcagtccggaggctgcggctgcagaagtaccgcctgcggagtaactgcaaagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8053 - RNA, 1901 nt, synthetic construct
  misc_feature 1..1901: note = mRNA product Design d-2 comprising derived and/or modified sequence from HRSV(A2)__F-del_DSCav1_mut8 (opt11)
  source 1..1901: mol_type = other RNA
gggagagcggctcggccattttgtcccagtcagtccggaggctgcggctgcagaagtaccgcctgcggagtaactgcaaagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8054 - RNA, 2217 nt, synthetic construct
  misc_feature 1..2217: note = mRNA product Design d-3 comprising derived and/or modified sequence from HRSV(A2)__F-del_DSCav1_mut8 (opt1)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8055 - RNA, 2217 nt, synthetic construct
  misc_feature 1..2217: note = mRNA product Design d-3 comprising derived and/or modified sequence from HRSV(A2)__F-del_DSCav1_mut8 (opt1)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8056 - RNA, 2217 nt, synthetic construct
  misc_feature 1..2217: note = mRNA product Design d-3 comprising derived and/or modified sequence from HRSV(A2)__F-del_DSCav1_mut8 (opt2)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8057 - RNA, 2217 nt, synthetic construct
  misc_feature 1..2217: note = mRNA product Design d-3 comprising derived and/or modified sequence from HRSV(A2)__F-del_DSCav1_mut8 (opt3)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8058 - RNA, 2217 nt, synthetic construct
  misc_feature 1..2217: note = mRNA product Design d-3 comprising derived and/or modified sequence from HRSV(A2)__F-del_DSCav1_mut8 (opt4)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8059 - RNA, 2217 nt, synthetic construct
  misc_feature 1..2217: note = mRNA product Design d-3 comprising derived and/or modified sequence from HRSV(A2)__F-del_DSCav1_mut8 (opt5)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8060 - RNA, 2217 nt, synthetic construct
  misc_feature 1..2217: note = mRNA product Design d-3 comprising derived and/or modified sequence from HRSV(A2)__F-del_DSCav1_mut8 (opt6)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8061 - RNA, 2217 nt, synthetic construct
  misc_feature 1..2217: note = mRNA product Design d-3 comprising derived and/or modified sequence from HRSV(A2)__F-del_DSCav1_mut8 (opt11)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8062 - RNA, 1900 nt, synthetic construct
  misc_feature 1..1900: note = mRNA product Design d-4 comprising derived and/or modified sequence from HRSV(A2)__F-del_DSCav1_mut8 (opt1)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8063 - RNA, 1900 nt, synthetic construct
  misc_feature 1..1900: note = mRNA product Design d-4 comprising derived and/or modified sequence from HRSV(A2)__F-del_DSCav1_mut8 (opt1)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8064 - RNA, 1900 nt, synthetic construct
  misc_feature 1..1900: note = mRNA product Design d-4 comprising derived and/or modified sequence from HRSV(A2)__F-del_DSCav1_mut8 (opt2)
  source 1..1900: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8065 - RNA, 1900 nt, synthetic construct
  misc_feature 1..1900: note = mRNA product Design d-4 comprising derived and/or modified sequence from HRSV(A2)__F-del_DSCav1_mut8 (opt3)
  source 1..1900: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8066 - RNA, 1900 nt, synthetic construct
  misc_feature 1..1900: note = mRNA product Design d-4 comprising derived and/or modified sequence from HRSV(A2)__F-del_DSCav1_mut8 (opt4)
  source 1..1900: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8067 - RNA, 1900 nt, synthetic construct
  misc_feature 1..1900: note = mRNA product Design d-4 comprising derived and/or modified sequence from HRSV(A2)__F-del_DSCav1_mut8 (opt5)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8068 - RNA, 1900 nt, synthetic construct
  misc_feature 1..1900: note = mRNA product Design d-4 comprising derived and/or modified sequence from HRSV(A2)__F-del_DSCav1_mut8 (opt6)
  source 1..1900: mol_type = other RNA
gggagagtcccgcagtcggcgtccagcggctctgcttgttcgtgtgtgtgtcgttgcaggccttattcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8069 - RNA, 1900 nt, synthetic construct
  misc_feature 1..1900: note = mRNA product Design d-4 comprising derived and/or modified sequence from HRSV(A2)__F-del_DSCav1_mut8 (opt11)
  source 1..1900: mol_type = other RNA
gggagagtcccgcagtcggcgtccagcggctctgcttgttcgtgtgtgtgtcgttgcaggccttattcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8070 - RNA, 1997 nt, synthetic construct
  misc_feature 1..1997: note = mRNA product Design d-5 comprising derived and/or modified sequence from HRSV(A2)__F-del_DSCav1_mut8 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8071 - RNA, 1997 nt, synthetic construct
  misc_feature 1..1997: note = mRNA product Design d-5 comprising derived and/or modified sequence from HRSV(A2)__F-del_DSCav1_mut8 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8072 - RNA, 1997 nt, synthetic construct
  misc_feature 1..1997: note = mRNA product Design d-5 comprising derived and/or modified sequence from HRSV(A2)__F-del_DSCav1_mut8 (opt2)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8073 - RNA, 1997 nt, synthetic construct
  misc_feature 1..1997: note = mRNA product Design d-5 comprising derived and/or modified sequence from HRSV(A2)__F-del_DSCav1_mut8 (opt3)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8074 - RNA, 1997 nt, synthetic construct
  misc_feature 1..1997: note = mRNA product Design d-5 comprising derived and/or modified sequence from HRSV(A2)__F-del_DSCav1_mut8 (opt4)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8075 - RNA, 1997 nt, synthetic construct
  misc_feature 1..1997: note = mRNA product Design d-5 comprising derived and/or modified sequence from HRSV(A2)__F-del_DSCav1_mut8 (opt5)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8076 - RNA, 1997 nt, synthetic construct
  misc_feature 1..1997: note = mRNA product Design d-5 comprising derived and/or modified sequence from HRSV(A2)__F-del_DSCav1_mut8 (opt6)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8077 - RNA, 1997 nt, synthetic construct
  misc_feature 1..1997: note = mRNA product Design d-5 comprising derived and/or modified sequence from HRSV(A2)__F-del_DSCav1_mut8 (opt11)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8078 - RNA, 1877 nt, synthetic construct
  misc_feature 1..1877: note = mRNA product Design e-1 comprising derived and/or modified sequence from HRSV(A2)__F-del_DSCav1_mut8 (opt1)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8079 - RNA, 1877 nt, synthetic construct
  misc_feature 1..1877: note = mRNA product Design e-1 comprising derived and/or modified sequence from HRSV(A2)__F-del_DSCav1_mut8 (opt1)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8080 - RNA, 1877 nt, synthetic construct
  misc_feature 1..1877: note = mRNA product Design e-1 comprising derived and/or modified sequence from HRSV(A2)__F-del_DSCav1_mut8 (opt2)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8081 - RNA, 1877 nt, synthetic construct
  misc_feature 1..1877: note = mRNA product Design e-1 comprising derived and/or modified sequence from HRSV(A2)__F-del_DSCav1_mut8 (opt3)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8082 - RNA, 1877 nt, synthetic construct
  misc_feature 1..1877: note = mRNA product Design e-1 comprising derived and/or modified sequence from HRSV(A2)__F-del_DSCav1_mut8 (opt4)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8083 - RNA, 1877 nt, synthetic construct
  misc_feature 1..1877: note = mRNA product Design e-1 comprising derived and/or modified sequence from HRSV(A2)__F-del_DSCav1_mut8 (opt5)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8084 - RNA, 1877 nt, synthetic construct
  misc_feature 1..1877: note = mRNA product Design e-1 comprising derived and/or modified sequence from HRSV(A2)__F-del_DSCav1_mut8 (opt6)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8085 - RNA, 1877 nt, synthetic construct
  misc_feature 1..1877: note = mRNA product Design e-1 comprising derived and/or modified sequence from HRSV(A2)__F-del_DSCav1_mut8 (opt11)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8086 - RNA, 1859 nt, synthetic construct
  misc_feature 1..1859: note = mRNA product Design e-2 comprising derived and/or modified sequence from HRSV(A2)__F-del_DSCav1_mut8 (opt1)
  source 1..1859: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8087 - RNA, 1859 nt, synthetic construct
  misc_feature 1..1859: note = mRNA product Design e-2 comprising derived and/or modified sequence from HRSV(A2)__F-del_DSCav1_mut8 (opt1)
  source 1..1859: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8088 - RNA, 1859 nt, synthetic construct
  misc_feature 1..1859: note = mRNA product Design e-2 comprising derived and/or modified sequence from HRSV(A2)__F-del_DSCav1_mut8 (opt2)
  source 1..1859: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8089 - RNA, 1859 nt, synthetic construct
  misc_feature 1..1859: note = mRNA product Design e-2 comprising derived and/or modified sequence from HRSV(A2)__F-del_DSCav1_mut8 (opt3)
  source 1..1859: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8090 - RNA, 1859 nt, synthetic construct
  misc_feature 1..1859: note = mRNA product Design e-2 comprising derived and/or modified sequence from HRSV(A2)__F-del_DSCav1_mut8 (opt4)
  source 1..1859: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8091 - RNA, 1859 nt, synthetic construct
  misc_feature 1..1859: note = mRNA product Design e-2 comprising derived and/or modified sequence from HRSV(A2)__F-del_DSCav1_mut8 (opt5)
  source 1..1859: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8092 - RNA, 1859 nt, synthetic construct
  misc_feature 1..1859: note = mRNA product Design e-2 comprising derived and/or modified sequence from HRSV(A2)__F-del_DSCav1_mut8 (opt6)
  source 1..1859: mol_type = other RNA
gggagacccgtgacccggaagttgtacggctacgcgactttccctcccacaaaccctcgcgcccttcctttcctacttgggcccggcagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8093 - RNA, 1859 nt, synthetic construct
  misc_feature 1..1859: note = mRNA product Design e-2 comprising derived and/or modified sequence from HRSV(A2)__F-del_DSCav1_mut8 (opt11)
  source 1..1859: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8094 - RNA, 1829 nt, synthetic construct
  misc_feature 1..1829: note = mRNA product Design e-3 comprising derived and/or modified sequence from HRSV(A2)__F-del_DSCav1_mut8 (opt1)
  source 1..1829: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8095 - RNA, 1829 nt, synthetic construct
  misc_feature 1..1829: note = mRNA product Design e-3 comprising derived and/or modified sequence from HRSV(A2)__F-del_DSCav1_mut8 (opt1)
  source 1..1829: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8096 - RNA, 1829 nt, synthetic construct
  misc_feature 1..1829: note = mRNA product Design e-3 comprising derived and/or modified sequence from HRSV(A2)__F-del_DSCav1_mut8 (opt2)
  source 1..1829: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8097 - RNA, 1829 nt, synthetic construct
  misc_feature 1..1829: note = mRNA product Design e-3 comprising derived and/or modified sequence from HRSV(A2)__F-del_DSCav1_mut8 (opt3)
  source 1..1829: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8098 - RNA, 1829 nt, synthetic construct
  misc_feature 1..1829: note = mRNA product Design e-3 comprising derived and/or modified sequence from HRSV(A2)__F-del_DSCav1_mut8 (opt4)
  source 1..1829: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8099 - RNA, 1829 nt, synthetic construct
  misc_feature 1..1829: note = mRNA product Design e-3 comprising derived and/or modified sequence from HRSV(A2)__F-del_DSCav1_mut8 (opt5)
  source 1..1829: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8100 - RNA, 1829 nt, synthetic construct
  misc_feature 1..1829: note = mRNA product Design e-3 comprising derived and/or modified sequence from HRSV(A2)__F-del_DSCav1_mut8 (opt6)
  source 1..1829: mol_type = other RNA
gggagactttcccattctgtagcagaatttggtgttgcctgtggtcttggtcccgcggagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8101 - RNA, 1829 nt, synthetic construct
  misc_feature 1..1829: note = mRNA product Design e-3 comprising derived and/or modified sequence from HRSV(A2)__F-del_DSCav1_mut8 (opt11)
  source 1..1829: mol_type = other RNA
gggagactttcccattctgtagcagaatttggtgttgcctgtggtcttggtcccgcggagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8102 - RNA, 1883 nt, synthetic construct
  misc_feature 1..1883: note = mRNA product Design e-4 comprising derived and/or modified sequence from HRSV(A2)__F-del_DSCav1_mut8 (opt1)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8103 - RNA, 1883 nt, synthetic construct
  misc_feature 1..1883: note = mRNA product Design e-4 comprising derived and/or modified sequence from HRSV(A2)__F-del_DSCav1_mut8 (opt1)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8104 - RNA, 1883 nt, synthetic construct
  misc_feature 1..1883: note = mRNA product Design e-4 comprising derived and/or modified sequence from HRSV(A2)__F-del_DSCav1_mut8 (opt2)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8105 - RNA, 1883 nt, synthetic construct
  misc_feature 1..1883: note = mRNA product Design e-4 comprising derived and/or modified sequence from HRSV(A2)__F-del_DSCav1_mut8 (opt3)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8106 - RNA, 1883 nt, synthetic construct
  misc_feature 1..1883: note = mRNA product Design e-4 comprising derived and/or modified sequence from HRSV(A2)__F-del_DSCav1_mut8 (opt4)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8107 - RNA, 1883 nt, synthetic construct
  misc_feature 1..1883: note = mRNA product Design e-4 comprising derived and/or modified sequence from HRSV(A2)__F-del_DSCav1_mut8 (opt5)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8108 - RNA, 1883 nt, synthetic construct
  misc_feature 1..1883: note = mRNA product Design e-4 comprising derived and/or modified sequence from HRSV(A2)__F-del_DSCav1_mut8 (opt6)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8109 - RNA, 1883 nt, synthetic construct
  misc_feature 1..1883: note = mRNA product Design e-4 comprising derived and/or modified sequence from HRSV(A2)__F-del_DSCav1_mut8 (opt11)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8110 - RNA, 1850 nt, synthetic construct
  misc_feature 1..1850: note = mRNA product Design e-5 comprising derived and/or modified sequence from HRSV(A2)__F-del_DSCav1_mut8 (opt1)
  source 1..1850: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8111 - RNA, 1850 nt, synthetic construct
  misc_feature 1..1850: note = mRNA product Design e-5 comprising derived and/or modified sequence from HRSV(A2)__F-del_DSCav1_mut8 (opt1)
  source 1..1850: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8112 - RNA, 1850 nt, synthetic construct
  misc_feature 1..1850: note = mRNA product Design e-5 comprising derived and/or modified sequence from HRSV(A2)__F-del_DSCav1_mut8 (opt2)
  source 1..1850: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8113 - RNA, 1850 nt, synthetic construct
  misc_feature 1..1850: note = mRNA product Design e-5 comprising derived and/or modified sequence from HRSV(A2)__F-del_DSCav1_mut8 (opt3)
  source 1..1850: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8114 - RNA, 1850 nt, synthetic construct
  misc_feature 1..1850: note = mRNA product Design e-5 comprising derived and/or modified sequence from HRSV(A2)__F-del_DSCav1_mut8 (opt4)
  source 1..1850: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8115 - RNA, 1850 nt, synthetic construct
  misc_feature 1..1850: note = mRNA product Design e-5 comprising derived and/or modified sequence from HRSV(A2)__F-del_DSCav1_mut8 (opt5)
  source 1..1850: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8116 - RNA, 1850 nt, synthetic construct
  misc_feature 1..1850: note = mRNA product Design e-5 comprising derived and/or modified sequence from HRSV(A2)__F-del_DSCav1_mut8 (opt6)
  source 1..1850: mol_type = other RNA
gggagagcggctcggccattttgtcccagtcagtccggaggctgcggctgcagaagtaccgcctgcggagtaactgcaaagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8117 - RNA, 1850 nt, synthetic construct
  misc_feature 1..1850: note = mRNA product Design e-5 comprising derived and/or modified sequence from HRSV(A2)__F-del_DSCav1_mut8 (opt11)
  source 1..1850: mol_type = other RNA
gggagagcggctcggccattttgtcccagtcagtccggaggctgcggctgcagaagtaccgcctgcggagtaactgcaaagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8118 - RNA, 1917 nt, synthetic construct
  misc_feature 1..1917: note = mRNA product Design e-6 comprising derived and/or modified sequence from HRSV(A2)__F-del_DSCav1_mut8 (opt1)
  source 1..1917: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8119 - RNA, 1917 nt, synthetic construct
  misc_feature 1..1917: note = mRNA product Design e-6 comprising derived and/or modified sequence from HRSV(A2)__F-del_DSCav1_mut8 (opt1)
  source 1..1917: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8120 - RNA, 1917 nt, synthetic construct
  misc_feature 1..1917: note = mRNA product Design e-6 comprising derived and/or modified sequence from HRSV(A2)__F-del_DSCav1_mut8 (opt2)
  source 1..1917: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8121 - RNA, 1917 nt, synthetic construct
  misc_feature 1..1917: note = mRNA product Design e-6 comprising derived and/or modified sequence from HRSV(A2)__F-del_DSCav1_mut8 (opt3)
  source 1..1917: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8122 - RNA, 1917 nt, synthetic construct
  misc_feature 1..1917: note = mRNA product Design e-6 comprising derived and/or modified sequence from HRSV(A2)__F-del_DSCav1_mut8 (opt4)
  source 1..1917: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8123 - RNA, 1917 nt, synthetic construct
  misc_feature 1..1917: note = mRNA product Design e-6 comprising derived and/or modified sequence from HRSV(A2)__F-del_DSCav1_mut8 (opt5)
  source 1..1917: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8124 - RNA, 1917 nt, synthetic construct
  misc_feature 1..1917: note = mRNA product Design e-6 comprising derived and/or modified sequence from HRSV(A2)__F-del_DSCav1_mut8 (opt6)
  source 1..1917: mol_type = other RNA
gggagagcggctcggccattttgtcccagtcagtccggaggctgcggctgcagaagtaccgcctgcggagtaactgcaaagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8125 - RNA, 1917 nt, synthetic construct
  misc_feature 1..1917: note = mRNA product Design e-6 comprising derived and/or modified sequence from HRSV(A2)__F-del_DSCav1_mut8 (opt11)
  source 1..1917: mol_type = other RNA
gggagagcggctcggccattttgtcccagtcagtccggaggctgcggctgcagaagtaccgcctgcggagtaactgcaaagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8126 - RNA, 2133 nt, synthetic construct
  misc_feature 1..2133: note = mRNA product Design f-1 comprising derived and/or modified sequence from HRSV(A2)__F-del_DSCav1_mut8 (opt1)
  source 1..2133: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8127 - RNA, 2133 nt, synthetic construct
  misc_feature 1..2133: note = mRNA product Design f-1 comprising derived and/or modified sequence from HRSV(A2)__F-del_DSCav1_mut8 (opt1)
  source 1..2133: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8128 - RNA, 2133 nt, synthetic construct
  misc_feature 1..2133: note = mRNA product Design f-1 comprising derived and/or modified sequence from HRSV(A2)__F-del_DSCav1_mut8 (opt2)
  source 1..2133: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8129 - RNA, 2133 nt, synthetic construct
  misc_feature 1..2133: note = mRNA product Design f-1 comprising derived and/or modified sequence from HRSV(A2)__F-del_DSCav1_mut8 (opt3)
  source 1..2133: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8130 - RNA, 2133 nt, synthetic construct
  misc_feature 1..2133: note = mRNA product Design f-1 comprising derived and/or modified sequence from HRSV(A2)__F-del_DSCav1_mut8 (opt4)
  source 1..2133: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8131 - RNA, 2133 nt, synthetic construct
  misc_feature 1..2133: note = mRNA product Design f-1 comprising derived and/or modified sequence from HRSV(A2)__F-del_DSCav1_mut8 (opt5)
  source 1..2133: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8132 - RNA, 2133 nt, synthetic construct
  misc_feature 1..2133: note = mRNA product Design f-1 comprising derived and/or modified sequence from HRSV(A2)__F-del_DSCav1_mut8 (opt6)
  source 1..2133: mol_type = other RNA
gggagagcggctcggccattttgtcccagtcagtccggaggctgcggctgcagaagtaccgcctgcggagtaactgcaaagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8133 - RNA, 2133 nt, synthetic construct
  misc_feature 1..2133: note = mRNA product Design f-1 comprising derived and/or modified sequence from HRSV(A2)__F-del_DSCav1_mut8 (opt11)
  source 1..2133: mol_type = other RNA
gggagagcggctcggccattttgtcccagtcagtccggaggctgcggctgcagaagtaccgcctgcggagtaactgcaaagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8134 - RNA, 1913 nt, synthetic construct
  misc_feature 1..1913: note = mRNA product Design f-2 comprising derived and/or modified sequence from HRSV(A2)__F-del_DSCav1_mut8 (opt1)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8135 - RNA, 1913 nt, synthetic construct
  misc_feature 1..1913: note = mRNA product Design f-2 comprising derived and/or modified sequence from HRSV(A2)__F-del_DSCav1_mut8 (opt1)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8136 - RNA, 1913 nt, synthetic construct
  misc_feature 1..1913: note = mRNA product Design f-2 comprising derived and/or modified sequence from HRSV(A2)__F-del_DSCav1_mut8 (opt2)
  source 1..1913: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8137 - RNA, 1913 nt, synthetic construct
  misc_feature 1..1913: note = mRNA product Design f-2 comprising derived and/or modified sequence from HRSV(A2)__F-del_DSCav1_mut8 (opt3)
  source 1..1913: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8138 - RNA, 1913 nt, synthetic construct
  misc_feature 1..1913: note = mRNA product Design f-2 comprising derived and/or modified sequence from HRSV(A2)__F-del_DSCav1_mut8 (opt4)
  source 1..1913: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8139 - RNA, 1913 nt, synthetic construct
  misc_feature 1..1913: note = mRNA product Design f-2 comprising derived and/or modified sequence from HRSV(A2)__F-del_DSCav1_mut8 (opt5)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8140 - RNA, 1913 nt, synthetic construct
  misc_feature 1..1913: note = mRNA product Design f-2 comprising derived and/or modified sequence from HRSV(A2)__F-del_DSCav1_mut8 (opt6)
  source 1..1913: mol_type = other RNA
gggagagcggctcggccattttgtcccagtcagtccggaggctgcggctgcagaagtaccgcctgcggagtaactgcaaagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8141 - RNA, 1913 nt, synthetic construct
  misc_feature 1..1913: note = mRNA product Design f-2 comprising derived and/or modified sequence from HRSV(A2)__F-del_DSCav1_mut8 (opt11)
  source 1..1913: mol_type = other RNA
gggagagcggctcggccattttgtcccagtcagtccggaggctgcggctgcagaagtaccgcctgcggagtaactgcaaagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8142 - RNA, 1904 nt, synthetic construct
  misc_feature 1..1904: note = mRNA product Design f-3 comprising derived and/or modified sequence from HRSV(A2)__F-del_DSCav1_mut8 (opt1)
  source 1..1904: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8143 - RNA, 1904 nt, synthetic construct
  misc_feature 1..1904: note = mRNA product Design f-3 comprising derived and/or modified sequence from HRSV(A2)__F-del_DSCav1_mut8 (opt1)
  source 1..1904: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8144 - RNA, 1904 nt, synthetic construct
  misc_feature 1..1904: note = mRNA product Design f-3 comprising derived and/or modified sequence from HRSV(A2)__F-del_DSCav1_mut8 (opt2)
  source 1..1904: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8145 - RNA, 1904 nt, synthetic construct
  misc_feature 1..1904: note = mRNA product Design f-3 comprising derived and/or modified sequence from HRSV(A2)__F-del_DSCav1_mut8 (opt3)
  source 1..1904: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8146 - RNA, 1904 nt, synthetic construct
  misc_feature 1..1904: note = mRNA product Design f-3 comprising derived and/or modified sequence from HRSV(A2)__F-del_DSCav1_mut8 (opt4)
  source 1..1904: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8147 - RNA, 1904 nt, synthetic construct
  misc_feature 1..1904: note = mRNA product Design f-3 comprising derived and/or modified sequence from HRSV(A2)__F-del_DSCav1_mut8 (opt5)
  source 1..1904: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8148 - RNA, 1904 nt, synthetic construct
  misc_feature 1..1904: note = mRNA product Design f-3 comprising derived and/or modified sequence from HRSV(A2)__F-del_DSCav1_mut8 (opt6)
  source 1..1904: mol_type = other RNA
gggagagtcccgcagtcggcgtccagcggctctgcttgttcgtgtgtgtgtcgttgcaggccttattcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8149 - RNA, 1904 nt, synthetic construct
  misc_feature 1..1904: note = mRNA product Design f-3 comprising derived and/or modified sequence from HRSV(A2)__F-del_DSCav1_mut8 (opt11)
  source 1..1904: mol_type = other RNA
gggagagtcccgcagtcggcgtccagcggctctgcttgttcgtgtgtgtgtcgttgcaggccttattcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8150 - RNA, 2120 nt, synthetic construct
  misc_feature 1..2120: note = mRNA product Design f-4 comprising derived and/or modified sequence from HRSV(A2)__F-del_DSCav1_mut8 (opt1)
  source 1..2120: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8151 - RNA, 2120 nt, synthetic construct
  misc_feature 1..2120: note = mRNA product Design f-4 comprising derived and/or modified sequence from HRSV(A2)__F-del_DSCav1_mut8 (opt1)
  source 1..2120: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8152 - RNA, 2120 nt, synthetic construct
  misc_feature 1..2120: note = mRNA product Design f-4 comprising derived and/or modified sequence from HRSV(A2)__F-del_DSCav1_mut8 (opt2)
  source 1..2120: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8153 - RNA, 2120 nt, synthetic construct
  misc_feature 1..2120: note = mRNA product Design f-4 comprising derived and/or modified sequence from HRSV(A2)__F-del_DSCav1_mut8 (opt3)
  source 1..2120: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8154 - RNA, 2120 nt, synthetic construct
  misc_feature 1..2120: note = mRNA product Design f-4 comprising derived and/or modified sequence from HRSV(A2)__F-del_DSCav1_mut8 (opt4)
  source 1..2120: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8155 - RNA, 2120 nt, synthetic construct
  misc_feature 1..2120: note = mRNA product Design f-4 comprising derived and/or modified sequence from HRSV(A2)__F-del_DSCav1_mut8 (opt5)
  source 1..2120: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8156 - RNA, 2120 nt, synthetic construct
  misc_feature 1..2120: note = mRNA product Design f-4 comprising derived and/or modified sequence from HRSV(A2)__F-del_DSCav1_mut8 (opt6)
  source 1..2120: mol_type = other RNA
gggagagtcccgcagtcggcgtccagcggctctgcttgttcgtgtgtgtgtcgttgcaggccttattcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8157 - RNA, 2120 nt, synthetic construct
  misc_feature 1..2120: note = mRNA product Design f-4 comprising derived and/or modified sequence from HRSV(A2)__F-del_DSCav1_mut8 (opt11)
  source 1..2120: mol_type = other RNA
gggagagtcccgcagtcggcgtccagcggctctgcttgttcgtgtgtgtgtcgttgcaggccttattcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8158 - RNA, 1896 nt, synthetic construct
  misc_feature 1..1896: note = mRNA product Design f-5 comprising derived and/or modified sequence from HRSV(A2)__F-del_DSCav1_mut8 (opt1)
  source 1..1896: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8159 - RNA, 1896 nt, synthetic construct
  misc_feature 1..1896: note = mRNA product Design f-5 comprising derived and/or modified sequence from HRSV(A2)__F-del_DSCav1_mut8 (opt1)
  source 1..1896: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8160 - RNA, 1896 nt, synthetic construct
  misc_feature 1..1896: note = mRNA product Design f-5 comprising derived and/or modified sequence from HRSV(A2)__F-del_DSCav1_mut8 (opt2)
  source 1..1896: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8161 - RNA, 1896 nt, synthetic construct
  misc_feature 1..1896: note = mRNA product Design f-5 comprising derived and/or modified sequence from HRSV(A2)__F-del_DSCav1_mut8 (opt3)
  source 1..1896: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8162 - RNA, 1896 nt, synthetic construct
  misc_feature 1..1896: note = mRNA product Design f-5 comprising derived and/or modified sequence from HRSV(A2)__F-del_DSCav1_mut8 (opt4)
  source 1..1896: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8163 - RNA, 1896 nt, synthetic construct
  misc_feature 1..1896: note = mRNA product Design f-5 comprising derived and/or modified sequence from HRSV(A2)__F-del_DSCav1_mut8 (opt5)
  source 1..1896: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8164 - RNA, 1896 nt, synthetic construct
  misc_feature 1..1896: note = mRNA product Design f-5 comprising derived and/or modified sequence from HRSV(A2)__F-del_DSCav1_mut8 (opt6)
  source 1..1896: mol_type = other RNA
gggagactttcccattctgtagcagaatttggtgttgcctgtggtcttggtcccgcggagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8165 - RNA, 1896 nt, synthetic construct
  misc_feature 1..1896: note = mRNA product Design f-5 comprising derived and/or modified sequence from HRSV(A2)__F-del_DSCav1_mut8 (opt11)
  source 1..1896: mol_type = other RNA
gggagactttcccattctgtagcagaatttggtgttgcctgtggtcttggtcccgcggagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8166 - RNA, 1892 nt, synthetic construct
  misc_feature 1..1892: note = mRNA product Design g-1 comprising derived and/or modified sequence from HRSV(A2)__F-del_DSCav1_mut8 (opt1)
  source 1..1892: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8167 - RNA, 1892 nt, synthetic construct
  misc_feature 1..1892: note = mRNA product Design g-1 comprising derived and/or modified sequence from HRSV(A2)__F-del_DSCav1_mut8 (opt1)
  source 1..1892: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8168 - RNA, 1892 nt, synthetic construct
  misc_feature 1..1892: note = mRNA product Design g-1 comprising derived and/or modified sequence from HRSV(A2)__F-del_DSCav1_mut8 (opt2)
  source 1..1892: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8169 - RNA, 1892 nt, synthetic construct
  misc_feature 1..1892: note = mRNA product Design g-1 comprising derived and/or modified sequence from HRSV(A2)__F-del_DSCav1_mut8 (opt3)
  source 1..1892: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8170 - RNA, 1892 nt, synthetic construct
  misc_feature 1..1892: note = mRNA product Design g-1 comprising derived and/or modified sequence from HRSV(A2)__F-del_DSCav1_mut8 (opt4)
  source 1..1892: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8171 - RNA, 1892 nt, synthetic construct
  misc_feature 1..1892: note = mRNA product Design g-1 comprising derived and/or modified sequence from HRSV(A2)__F-del_DSCav1_mut8 (opt5)
  source 1..1892: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8172 - RNA, 1892 nt, synthetic construct
  misc_feature 1..1892: note = mRNA product Design g-1 comprising derived and/or modified sequence from HRSV(A2)__F-del_DSCav1_mut8 (opt6)
  source 1..1892: mol_type = other RNA
gggagactttcccattctgtagcagaatttggtgttgcctgtggtcttggtcccgcggagaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8173 - RNA, 1892 nt, synthetic construct
  misc_feature 1..1892: note = mRNA product Design g-1 comprising derived and/or modified sequence from HRSV(A2)__F-del_DSCav1_mut8 (opt11)
  source 1..1892: mol_type = other RNA
gggagactttcccattctgtagcagaatttggtgttgcctgtggtcttggtcccgcggagaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8174 - RNA, 1907 nt, synthetic construct
  misc_feature 1..1907: note = mRNA product Design g-2 comprising derived and/or modified sequence from HRSV(A2)__F-del_DSCav1_mut8 (opt1)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8175 - RNA, 1907 nt, synthetic construct
  misc_feature 1..1907: note = mRNA product Design g-2 comprising derived and/or modified sequence from HRSV(A2)__F-del_DSCav1_mut8 (opt1)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8176 - RNA, 1907 nt, synthetic construct
  misc_feature 1..1907: note = mRNA product Design g-2 comprising derived and/or modified sequence from HRSV(A2)__F-del_DSCav1_mut8 (opt2)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8177 - RNA, 1907 nt, synthetic construct
  misc_feature 1..1907: note = mRNA product Design g-2 comprising derived and/or modified sequence from HRSV(A2)__F-del_DSCav1_mut8 (opt3)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8178 - RNA, 1907 nt, synthetic construct
  misc_feature 1..1907: note = mRNA product Design g-2 comprising derived and/or modified sequence from HRSV(A2)__F-del_DSCav1_mut8 (opt4)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8179 - RNA, 1907 nt, synthetic construct
  misc_feature 1..1907: note = mRNA product Design g-2 comprising derived and/or modified sequence from HRSV(A2)__F-del_DSCav1_mut8 (opt5)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8180 - RNA, 1907 nt, synthetic construct
  misc_feature 1..1907: note = mRNA product Design g-2 comprising derived and/or modified sequence from HRSV(A2)__F-del_DSCav1_mut8 (opt6)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8181 - RNA, 1907 nt, synthetic construct
  misc_feature 1..1907: note = mRNA product Design g-2 comprising derived and/or modified sequence from HRSV(A2)__F-del_DSCav1_mut8 (opt11)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8182 - RNA, 2139 nt, synthetic construct
  misc_feature 1..2139: note = mRNA product Design g-3 comprising derived and/or modified sequence from HRSV(A2)__F-del_DSCav1_mut8 (opt1)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8183 - RNA, 2139 nt, synthetic construct
  misc_feature 1..2139: note = mRNA product Design g-3 comprising derived and/or modified sequence from HRSV(A2)__F-del_DSCav1_mut8 (opt1)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8184 - RNA, 2139 nt, synthetic construct
  misc_feature 1..2139: note = mRNA product Design g-3 comprising derived and/or modified sequence from HRSV(A2)__F-del_DSCav1_mut8 (opt2)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8185 - RNA, 2139 nt, synthetic construct
  misc_feature 1..2139: note = mRNA product Design g-3 comprising derived and/or modified sequence from HRSV(A2)__F-del_DSCav1_mut8 (opt3)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8186 - RNA, 2139 nt, synthetic construct
  misc_feature 1..2139: note = mRNA product Design g-3 comprising derived and/or modified sequence from HRSV(A2)__F-del_DSCav1_mut8 (opt4)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8187 - RNA, 2139 nt, synthetic construct
  misc_feature 1..2139: note = mRNA product Design g-3 comprising derived and/or modified sequence from HRSV(A2)__F-del_DSCav1_mut8 (opt5)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8188 - RNA, 2139 nt, synthetic construct
  misc_feature 1..2139: note = mRNA product Design g-3 comprising derived and/or modified sequence from HRSV(A2)__F-del_DSCav1_mut8 (opt6)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8189 - RNA, 2139 nt, synthetic construct
  misc_feature 1..2139: note = mRNA product Design g-3 comprising derived and/or modified sequence from HRSV(A2)__F-del_DSCav1_mut8 (opt11)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8190 - RNA, 1934 nt, synthetic construct
  misc_feature 1..1934: note = mRNA product Design g-4 comprising derived and/or modified sequence from HRSV(A2)__F-del_DSCav1_mut8 (opt1)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8191 - RNA, 1934 nt, synthetic construct
  misc_feature 1..1934: note = mRNA product Design g-4 comprising derived and/or modified sequence from HRSV(A2)__F-del_DSCav1_mut8 (opt1)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8192 - RNA, 1934 nt, synthetic construct
  misc_feature 1..1934: note = mRNA product Design g-4 comprising derived and/or modified sequence from HRSV(A2)__F-del_DSCav1_mut8 (opt2)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8193 - RNA, 1934 nt, synthetic construct
  misc_feature 1..1934: note = mRNA product Design g-4 comprising derived and/or modified sequence from HRSV(A2)__F-del_DSCav1_mut8 (opt3)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8194 - RNA, 1934 nt, synthetic construct
  misc_feature 1..1934: note = mRNA product Design g-4 comprising derived and/or modified sequence from HRSV(A2)__F-del_DSCav1_mut8 (opt4)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8195 - RNA, 1934 nt, synthetic construct
  misc_feature 1..1934: note = mRNA product Design g-4 comprising derived and/or modified sequence from HRSV(A2)__F-del_DSCav1_mut8 (opt5)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8196 - RNA, 1934 nt, synthetic construct
  misc_feature 1..1934: note = mRNA product Design g-4 comprising derived and/or modified sequence from HRSV(A2)__F-del_DSCav1_mut8 (opt6)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8197 - RNA, 1934 nt, synthetic construct
  misc_feature 1..1934: note = mRNA product Design g-4 comprising derived and/or modified sequence from HRSV(A2)__F-del_DSCav1_mut8 (opt11)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8198 - RNA, 1910 nt, synthetic construct
  misc_feature 1..1910: note = mRNA product Design g-5 comprising derived and/or modified sequence from HRSV(A2)__F-del_DSCav1_mut8 (opt1)
  source 1..1910: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8199 - RNA, 1910 nt, synthetic construct
  misc_feature 1..1910: note = mRNA product Design g-5 comprising derived and/or modified sequence from HRSV(A2)__F-del_DSCav1_mut8 (opt1)
  source 1..1910: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8200 - RNA, 1910 nt, synthetic construct
  misc_feature 1..1910: note = mRNA product Design g-5 comprising derived and/or modified sequence from HRSV(A2)__F-del_DSCav1_mut8 (opt2)
  source 1..1910: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8201 - RNA, 1910 nt, synthetic construct
  misc_feature 1..1910: note = mRNA product Design g-5 comprising derived and/or modified sequence from HRSV(A2)__F-del_DSCav1_mut8 (opt3)
  source 1..1910: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8202 - RNA, 1910 nt, synthetic construct
  misc_feature 1..1910: note = mRNA product Design g-5 comprising derived and/or modified sequence from HRSV(A2)__F-del_DSCav1_mut8 (opt4)
  source 1..1910: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8203 - RNA, 1910 nt, synthetic construct
  misc_feature 1..1910: note = mRNA product Design g-5 comprising derived and/or modified sequence from HRSV(A2)__F-del_DSCav1_mut8 (opt5)
  source 1..1910: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8204 - RNA, 1910 nt, synthetic construct
  misc_feature 1..1910: note = mRNA product Design g-5 comprising derived and/or modified sequence from HRSV(A2)__F-del_DSCav1_mut8 (opt6)
  source 1..1910: mol_type = other RNA
gggagacccgtgacccggaagttgtacggctacgcgactttccctcccacaaaccctcgcgcccttcctttcctacttgggcccggcagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8205 - RNA, 1910 nt, synthetic construct
  misc_feature 1..1910: note = mRNA product Design g-5 comprising derived and/or modified sequence from HRSV(A2)__F-del_DSCav1_mut8 (opt11)
  source 1..1910: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8206 - RNA, 1926 nt, synthetic construct
  misc_feature 1..1926: note = mRNA product Design h-1 comprising derived and/or modified sequence from HRSV(A2)__F-del_DSCav1_mut8 (opt1)
  source 1..1926: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8207 - RNA, 1926 nt, synthetic construct
  misc_feature 1..1926: note = mRNA product Design h-1 comprising derived and/or modified sequence from HRSV(A2)__F-del_DSCav1_mut8 (opt1)
  source 1..1926: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8208 - RNA, 1926 nt, synthetic construct
  misc_feature 1..1926: note = mRNA product Design h-1 comprising derived and/or modified sequence from HRSV(A2)__F-del_DSCav1_mut8 (opt2)
  source 1..1926: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8209 - RNA, 1926 nt, synthetic construct
  misc_feature 1..1926: note = mRNA product Design h-1 comprising derived and/or modified sequence from HRSV(A2)__F-del_DSCav1_mut8 (opt3)
  source 1..1926: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8210 - RNA, 1926 nt, synthetic construct
  misc_feature 1..1926: note = mRNA product Design h-1 comprising derived and/or modified sequence from HRSV(A2)__F-del_DSCav1_mut8 (opt4)
  source 1..1926: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8211 - RNA, 1926 nt, synthetic construct
  misc_feature 1..1926: note = mRNA product Design h-1 comprising derived and/or modified sequence from HRSV(A2)__F-del_DSCav1_mut8 (opt5)
  source 1..1926: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8212 - RNA, 1926 nt, synthetic construct
  misc_feature 1..1926: note = mRNA product Design h-1 comprising derived and/or modified sequence from HRSV(A2)__F-del_DSCav1_mut8 (opt6)
  source 1..1926: mol_type = other RNA
gggagacccgtgacccggaagttgtacggctacgcgactttccctcccacaaaccctcgcgcccttcctttcctacttgggcccggcagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8213 - RNA, 1926 nt, synthetic construct
  misc_feature 1..1926: note = mRNA product Design h-1 comprising derived and/or modified sequence from HRSV(A2)__F-del_DSCav1_mut8 (opt11)
  source 1..1926: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8214 - RNA, 2142 nt, synthetic construct
  misc_feature 1..2142: note = mRNA product Design h-2 comprising derived and/or modified sequence from HRSV(A2)__F-del_DSCav1_mut8 (opt1)
  source 1..2142: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8215 - RNA, 2142 nt, synthetic construct
  misc_feature 1..2142: note = mRNA product Design h-2 comprising derived and/or modified sequence from HRSV(A2)__F-del_DSCav1_mut8 (opt1)
  source 1..2142: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8216 - RNA, 2142 nt, synthetic construct
  misc_feature 1..2142: note = mRNA product Design h-2 comprising derived and/or modified sequence from HRSV(A2)__F-del_DSCav1_mut8 (opt2)
  source 1..2142: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8217 - RNA, 2142 nt, synthetic construct
  misc_feature 1..2142: note = mRNA product Design h-2 comprising derived and/or modified sequence from HRSV(A2)__F-del_DSCav1_mut8 (opt3)
  source 1..2142: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8218 - RNA, 2142 nt, synthetic construct
  misc_feature 1..2142: note = mRNA product Design h-2 comprising derived and/or modified sequence from HRSV(A2)__F-del_DSCav1_mut8 (opt4)
  source 1..2142: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8219 - RNA, 2142 nt, synthetic construct
  misc_feature 1..2142: note = mRNA product Design h-2 comprising derived and/or modified sequence from HRSV(A2)__F-del_DSCav1_mut8 (opt5)
  source 1..2142: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8220 - RNA, 2142 nt, synthetic construct
  misc_feature 1..2142: note = mRNA product Design h-2 comprising derived and/or modified sequence from HRSV(A2)__F-del_DSCav1_mut8 (opt6)
  source 1..2142: mol_type = other RNA
gggagacccgtgacccggaagttgtacggctacgcgactttccctcccacaaaccctcgcgcccttcctttcctacttgggcccggcagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8221 - RNA, 2142 nt, synthetic construct
  misc_feature 1..2142: note = mRNA product Design h-2 comprising derived and/or modified sequence from HRSV(A2)__F-del_DSCav1_mut8 (opt11)
  source 1..2142: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8222 - RNA, 1922 nt, synthetic construct
  misc_feature 1..1922: note = mRNA product Design h-3 comprising derived and/or modified sequence from HRSV(A2)__F-del_DSCav1_mut8 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8223 - RNA, 1922 nt, synthetic construct
  misc_feature 1..1922: note = mRNA product Design h-3 comprising derived and/or modified sequence from HRSV(A2)__F-del_DSCav1_mut8 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8224 - RNA, 1922 nt, synthetic construct
  misc_feature 1..1922: note = mRNA product Design h-3 comprising derived and/or modified sequence from HRSV(A2)__F-del_DSCav1_mut8 (opt2)
  source 1..1922: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8225 - RNA, 1922 nt, synthetic construct
  misc_feature 1..1922: note = mRNA product Design h-3 comprising derived and/or modified sequence from HRSV(A2)__F-del_DSCav1_mut8 (opt3)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8226 - RNA, 1922 nt, synthetic construct
  misc_feature 1..1922: note = mRNA product Design h-3 comprising derived and/or modified sequence from HRSV(A2)__F-del_DSCav1_mut8 (opt4)
  source 1..1922: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8227 - RNA, 1922 nt, synthetic construct
  misc_feature 1..1922: note = mRNA product Design h-3 comprising derived and/or modified sequence from HRSV(A2)__F-del_DSCav1_mut8 (opt5)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8228 - RNA, 1922 nt, synthetic construct
  misc_feature 1..1922: note = mRNA product Design h-3 comprising derived and/or modified sequence from HRSV(A2)__F-del_DSCav1_mut8 (opt6)
  source 1..1922: mol_type = other RNA
gggagacccgtgacccggaagttgtacggctacgcgactttccctcccacaaaccctcgcgcccttcctttcctacttgggcccggcagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8229 - RNA, 1922 nt, synthetic construct
  misc_feature 1..1922: note = mRNA product Design h-3 comprising derived and/or modified sequence from HRSV(A2)__F-del_DSCav1_mut8 (opt11)
  source 1..1922: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8230 - RNA, 1985 nt, synthetic construct
  misc_feature 1..1985: note = mRNA product Design h-4 comprising derived and/or modified sequence from HRSV(A2)__F-del_DSCav1_mut8 (opt1)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8231 - RNA, 1985 nt, synthetic construct
  misc_feature 1..1985: note = mRNA product Design h-4 comprising derived and/or modified sequence from HRSV(A2)__F-del_DSCav1_mut8 (opt1)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8232 - RNA, 1985 nt, synthetic construct
  misc_feature 1..1985: note = mRNA product Design h-4 comprising derived and/or modified sequence from HRSV(A2)__F-del_DSCav1_mut8 (opt2)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8233 - RNA, 1985 nt, synthetic construct
  misc_feature 1..1985: note = mRNA product Design h-4 comprising derived and/or modified sequence from HRSV(A2)__F-del_DSCav1_mut8 (opt3)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8234 - RNA, 1985 nt, synthetic construct
  misc_feature 1..1985: note = mRNA product Design h-4 comprising derived and/or modified sequence from HRSV(A2)__F-del_DSCav1_mut8 (opt4)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8235 - RNA, 1985 nt, synthetic construct
  misc_feature 1..1985: note = mRNA product Design h-4 comprising derived and/or modified sequence from HRSV(A2)__F-del_DSCav1_mut8 (opt5)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8236 - RNA, 1985 nt, synthetic construct
  misc_feature 1..1985: note = mRNA product Design h-4 comprising derived and/or modified sequence from HRSV(A2)__F-del_DSCav1_mut8 (opt6)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8237 - RNA, 1985 nt, synthetic construct
  misc_feature 1..1985: note = mRNA product Design h-4 comprising derived and/or modified sequence from HRSV(A2)__F-del_DSCav1_mut8 (opt11)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8238 - RNA, 2001 nt, synthetic construct
  misc_feature 1..2001: note = mRNA product Design h-5 comprising derived and/or modified sequence from HRSV(A2)__F-del_DSCav1_mut8 (opt1)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8239 - RNA, 2001 nt, synthetic construct
  misc_feature 1..2001: note = mRNA product Design h-5 comprising derived and/or modified sequence from HRSV(A2)__F-del_DSCav1_mut8 (opt1)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8240 - RNA, 2001 nt, synthetic construct
  misc_feature 1..2001: note = mRNA product Design h-5 comprising derived and/or modified sequence from HRSV(A2)__F-del_DSCav1_mut8 (opt2)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8241 - RNA, 2001 nt, synthetic construct
  misc_feature 1..2001: note = mRNA product Design h-5 comprising derived and/or modified sequence from HRSV(A2)__F-del_DSCav1_mut8 (opt3)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8242 - RNA, 2001 nt, synthetic construct
  misc_feature 1..2001: note = mRNA product Design h-5 comprising derived and/or modified sequence from HRSV(A2)__F-del_DSCav1_mut8 (opt4)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8243 - RNA, 2001 nt, synthetic construct
  misc_feature 1..2001: note = mRNA product Design h-5 comprising derived and/or modified sequence from HRSV(A2)__F-del_DSCav1_mut8 (opt5)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8244 - RNA, 2001 nt, synthetic construct
  misc_feature 1..2001: note = mRNA product Design h-5 comprising derived and/or modified sequence from HRSV(A2)__F-del_DSCav1_mut8 (opt6)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8245 - RNA, 2001 nt, synthetic construct
  misc_feature 1..2001: note = mRNA product Design h-5 comprising derived and/or modified sequence from HRSV(A2)__F-del_DSCav1_mut8 (opt11)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8246 - RNA, 1934 nt, synthetic construct
  misc_feature 1..1934: note = mRNA product Design i-1 comprising derived and/or modified sequence from HRSV(A2)__F-del_DSCav1_mut8 (opt1)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8247 - RNA, 1934 nt, synthetic construct
  misc_feature 1..1934: note = mRNA product Design i-1 comprising derived and/or modified sequence from HRSV(A2)__F-del_DSCav1_mut8 (opt1)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8248 - RNA, 1934 nt, synthetic construct
  misc_feature 1..1934: note = mRNA product Design i-1 comprising derived and/or modified sequence from HRSV(A2)__F-del_DSCav1_mut8 (opt2)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8249 - RNA, 1934 nt, synthetic construct
  misc_feature 1..1934: note = mRNA product Design i-1 comprising derived and/or modified sequence from HRSV(A2)__F-del_DSCav1_mut8 (opt3)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8250 - RNA, 1934 nt, synthetic construct
  misc_feature 1..1934: note = mRNA product Design i-1 comprising derived and/or modified sequence from HRSV(A2)__F-del_DSCav1_mut8 (opt4)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8251 - RNA, 1934 nt, synthetic construct
  misc_feature 1..1934: note = mRNA product Design i-1 comprising derived and/or modified sequence from HRSV(A2)__F-del_DSCav1_mut8 (opt5)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8252 - RNA, 1934 nt, synthetic construct
  misc_feature 1..1934: note = mRNA product Design i-1 comprising derived and/or modified sequence from HRSV(A2)__F-del_DSCav1_mut8 (opt6)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8253 - RNA, 1934 nt, synthetic construct
  misc_feature 1..1934: note = mRNA product Design i-1 comprising derived and/or modified sequence from HRSV(A2)__F-del_DSCav1_mut8 (opt11)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8254 - RNA, 1934 nt, synthetic construct
  misc_feature 1..1934: note = mRNA product Design i-2 comprising derived and/or modified sequence from HRSV(A2)__F-del_DSCav1_mut8 (opt1)
  source 1..1934: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8255 - RNA, 1934 nt, synthetic construct
  misc_feature 1..1934: note = mRNA product Design i-2 comprising derived and/or modified sequence from HRSV(A2)__F-del_DSCav1_mut8 (opt1)
  source 1..1934: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8256 - RNA, 1934 nt, synthetic construct
  misc_feature 1..1934: note = mRNA product Design i-2 comprising derived and/or modified sequence from HRSV(A2)__F-del_DSCav1_mut8 (opt2)
  source 1..1934: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8257 - RNA, 1934 nt, synthetic construct
  misc_feature 1..1934: note = mRNA product Design i-2 comprising derived and/or modified sequence from HRSV(A2)__F-del_DSCav1_mut8 (opt3)
  source 1..1934: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8258 - RNA, 1934 nt, synthetic construct
  misc_feature 1..1934: note = mRNA product Design i-2 comprising derived and/or modified sequence from HRSV(A2)__F-del_DSCav1_mut8 (opt4)
  source 1..1934: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8259 - RNA, 1934 nt, synthetic construct
  misc_feature 1..1934: note = mRNA product Design i-2 comprising derived and/or modified sequence from HRSV(A2)__F-del_DSCav1_mut8 (opt5)
  source 1..1934: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8260 - RNA, 1934 nt, synthetic construct
  misc_feature 1..1934: note = mRNA product Design i-2 comprising derived and/or modified sequence from HRSV(A2)__F-del_DSCav1_mut8 (opt6)
  source 1..1934: mol_type = other RNA
gggagaggcgctgcctacggaggtggcagccatctccttctcggcatcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8261 - RNA, 1934 nt, synthetic construct
  misc_feature 1..1934: note = mRNA product Design i-2 comprising derived and/or modified sequence from HRSV(A2)__F-del_DSCav1_mut8 (opt11)
  source 1..1934: mol_type = other RNA
gggagaggcgctgcctacggaggtggcagccatctccttctcggcatcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8262 - RNA, 1930 nt, synthetic construct
  misc_feature 1..1930: note = mRNA product Design i-2 comprising derived and/or modified sequence from HRSV(A2)__F-del_DSCav1_mut8 (opt1)
  source 1..1930: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8263 - RNA, 1930 nt, synthetic construct
  misc_feature 1..1930: note = mRNA product Design i-2 comprising derived and/or modified sequence from HRSV(A2)__F-del_DSCav1_mut8 (opt1)
  source 1..1930: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8264 - RNA, 1930 nt, synthetic construct
  misc_feature 1..1930: note = mRNA product Design i-2 comprising derived and/or modified sequence from HRSV(A2)__F-del_DSCav1_mut8 (opt2)
  source 1..1930: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8265 - RNA, 1930 nt, synthetic construct
  misc_feature 1..1930: note = mRNA product Design i-2 comprising derived and/or modified sequence from HRSV(A2)__F-del_DSCav1_mut8 (opt3)
  source 1..1930: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8266 - RNA, 1930 nt, synthetic construct
  misc_feature 1..1930: note = mRNA product Design i-2 comprising derived and/or modified sequence from HRSV(A2)__F-del_DSCav1_mut8 (opt4)
  source 1..1930: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8267 - RNA, 1930 nt, synthetic construct
  misc_feature 1..1930: note = mRNA product Design i-2 comprising derived and/or modified sequence from HRSV(A2)__F-del_DSCav1_mut8 (opt5)
  source 1..1930: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8268 - RNA, 1930 nt, synthetic construct
  misc_feature 1..1930: note = mRNA product Design i-2 comprising derived and/or modified sequence from HRSV(A2)__F-del_DSCav1_mut8 (opt6)
  source 1..1930: mol_type = other RNA
ggggcgctgcctacggaggtggcagccatctccttctcggcatcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8269 - RNA, 1930 nt, synthetic construct
  misc_feature 1..1930: note = mRNA product Design i-2 comprising derived and/or modified sequence from HRSV(A2)__F-del_DSCav1_mut8 (opt11)
  source 1..1930: mol_type = other RNA
ggggcgctgcctacggaggtggcagccatctccttctcggcatcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8270 - RNA, 1765 nt, synthetic construct
  misc_feature 1..1765: note = mRNA product Design i-3 comprising derived and/or modified sequence from HRSV(A2)__F-del_DSCav1_mut8 (opt1)
  source 1..1765: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8271 - RNA, 1765 nt, synthetic construct
  misc_feature 1..1765: note = mRNA product Design i-3 comprising derived and/or modified sequence from HRSV(A2)__F-del_DSCav1_mut8 (opt1)
  source 1..1765: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8272 - RNA, 1765 nt, synthetic construct
  misc_feature 1..1765: note = mRNA product Design i-3 comprising derived and/or modified sequence from HRSV(A2)__F-del_DSCav1_mut8 (opt2)
  source 1..1765: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8273 - RNA, 1765 nt, synthetic construct
  misc_feature 1..1765: note = mRNA product Design i-3 comprising derived and/or modified sequence from HRSV(A2)__F-del_DSCav1_mut8 (opt3)
  source 1..1765: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8274 - RNA, 1765 nt, synthetic construct
  misc_feature 1..1765: note = mRNA product Design i-3 comprising derived and/or modified sequence from HRSV(A2)__F-del_DSCav1_mut8 (opt4)
  source 1..1765: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8275 - RNA, 1765 nt, synthetic construct
  misc_feature 1..1765: note = mRNA product Design i-3 comprising derived and/or modified sequence from HRSV(A2)__F-del_DSCav1_mut8 (opt5)
  source 1..1765: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8276 - RNA, 1765 nt, synthetic construct
  misc_feature 1..1765: note = mRNA product Design i-3 comprising derived and/or modified sequence from HRSV(A2)__F-del_DSCav1_mut8 (opt6)
  source 1..1765: mol_type = other RNA
gggagaaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8277 - RNA, 1765 nt, synthetic construct
  misc_feature 1..1765: note = mRNA product Design i-3 comprising derived and/or modified sequence from HRSV(A2)__F-del_DSCav1_mut8 (opt11)
  source 1..1765: mol_type = other RNA
gggagaaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8278 - RNA, 2068 nt, synthetic construct
  misc_feature 1..2068: note = mRNA product Design i-4 comprising derived and/or modified sequence from HRSV(A2)__F-del_DSCav1 (opt1) R4745/R5717
  source 1..2068: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8279 - protein, 589 aa, synthetic construct
  REGION 1..589: note = derived and/or modified protein sequence (wt) from HRSV__AJF44801.1__F0
MIPQARTKLNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8280 - protein, 589 aa, synthetic construct
  REGION 1..589: note = derived and/or modified protein sequence (wt) from HRSV__AJF44759.1__F0
MIPQARTKLNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTRSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8281 - protein, 589 aa, synthetic construct
  REGION 1..589: note = derived and/or modified protein sequence (wt) from HRSV__AJF44661.1__F0
MIPQARTELNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWELHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8282 - protein, 589 aa, synthetic construct
  REGION 1..589: note = derived and/or modified protein sequence (wt) from HRSV__AJF44602.1__F0
MIPQARTELNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8283 - protein, 575 aa, synthetic construct
  REGION 1..575: note = derived and/or modified protein sequence (wt) from HRSV__2207424A__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTSTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLFLYCKARSTPVTLSKDQLSGIINNIAFSN

SEQ ID NO: 8284 - protein, 575 aa, synthetic construct
  REGION 1..575: note = derived and/or modified protein sequence (wt) from HRSV__AAB38520.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVLCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLLLYCKARSTPVTLSKDQLSGIINNIAFSN

SEQ ID NO: 8285 - protein, 575 aa, synthetic construct
  REGION 1..575: note = derived and/or modified protein sequence (wt) from HRSV__AAB38517.1__F0
MELPILKTNAITAILAAVTLCFASGQNITEEFYQSTCSAVSKGYLSALRTGWYTSVITIELSNIKENKCNGTDAKVKLIKQELDKYKSAVTELQLLTQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTSTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGIINNIAFSN

SEQ ID NO: 8286 - protein, 575 aa, synthetic construct
  REGION 1..575: note = derived and/or modified protein sequence (wt) from HRSV__AAB38519.1__F0
MELPILKTNAITTILAAVTLCFASSQNITEEFYQSTCSVVSKGYLSALRIGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKTYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVLCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLLLYCKARSTPVTLSKDQLSGIINNIAFSN

SEQ ID NO: 8287 - protein, 575 aa, synthetic construct
  REGION 1..575: note = derived and/or modified protein sequence (wt) from HRSV__AAB38518.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKKTNVTLSKKRKRRFLGFLLGVGSATASGIAVSKVLHLEGEVNKIKSALLTTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTSTDRGWYCDNAGSVSFFPQADTCKVQSNRVFWDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGIINNIAFSN

SEQ ID NO: 8288 - protein, 574 aa, synthetic construct
  REGION 1..574: note = derived and/or modified protein sequence (wt) from HRSV__AVQ93587.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLVSLIAIGLLLYCKAKNTPVTLSKDQLSGINNIAFSK

SEQ ID NO: 8289 - protein, 574 aa, synthetic construct
  REGION 1..574: note = derived and/or modified protein sequence (wt) from HRSV__AVQ93599.1__F0
MELLIHRSSAIFLTLVINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLTVSISKKRKRRFLGFLLGVGSAIASGIAVSKVLHLEGEVNKIKNALQSTNKAVVSLSNGVSVLTSKVLDLKNYINSQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8290 - protein, 574 aa, synthetic construct
  REGION 1..574: note = derived and/or modified protein sequence (wt) from HRSV__AVQ93571.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKFMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNFYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8291 - protein, 574 aa, synthetic construct
  REGION 1..574: note = derived and/or modified protein sequence (wt) from HRSV__AVQ93568.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMTTAIIIVIIVVLLSLIAIGLLLYCKAKNTPVTLSKDQLSGINNIAFSK

SEQ ID NO: 8292 - protein, 574 aa, synthetic construct
  REGION 1..574: note = derived and/or modified protein sequence (wt) from HRSV__AVQ93589.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLVSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8293 - protein, 574 aa, synthetic construct
  REGION 1..574: note = derived and/or modified protein sequence (wt) from HRSV__AVQ93597.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPVVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8294 - protein, 574 aa, synthetic construct
  REGION 1..574: note = derived and/or modified protein sequence (wt) from HRSV__AVQ93563.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNACVTTPLSTYMLTNSELLSLINDMPITNDQKKLMSSNVQIVRLQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8295 - protein, 574 aa, synthetic construct
  REGION 1..574: note = derived and/or modified protein sequence (wt) from HRSV__AVQ93594.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKSTPVTLSKDQLSGINNIAFSK

SEQ ID NO: 8296 - protein, 574 aa, synthetic construct
  REGION 1..574: note = derived and/or modified protein sequence (wt) from HRSV__AVQ93601.1__F0
MELLIHRSSAIFLTLAINALYPTSSQNITEEFYQSTCSAVSRGYLSALRTGWYTSVITIELSNIKETNCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8297 - protein, 574 aa, synthetic construct
  REGION 1..574: note = derived and/or modified protein sequence (wt) from HRSV__AVQ93562.1__F0
MELLIHRSSAIFLTFAINALYFTSSQNITEEFYQSTCSAVSRGYLSALRTGWYTSVITIELSNIKETKCNGTDTKVKLIKQELDKYKNAVTELQLLMQNTPAVNNRARREAPQYMDYTINTSKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEGVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLMLYCKAKNTPVTLSKDQLSGINNIAFSK

SEQ ID NO: 8298 - protein, 574 aa, synthetic construct
  REGION 1..574: note = derived and/or modified protein sequence (wt) from HRSV__AVQ93561.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQGYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8299 - protein, 574 aa, synthetic construct
  REGION 1..574: note = derived and/or modified protein sequence (wt) from HRSV__AVQ93607.1__F0
MELLIHRSSAIFLTLAINALYPTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCNYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8300 - protein, 574 aa, synthetic construct
  REGION 1..574: note = derived and/or modified protein sequence (wt) from HRSV__AVQ93588.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAVGLLLYCKAKNTPVTLSKDQLSGINNIAFSK

SEQ ID NO: 8301 - protein, 574 aa, synthetic construct
  REGION 1..574: note = derived and/or modified protein sequence (wt) from HRSV__AVQ93575.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKVKNTPVTLSKDQLSGINNIAFSK

SEQ ID NO: 8302 - protein, 574 aa, synthetic construct
  REGION 1..574: note = derived and/or modified protein sequence (wt) from HRSV__AVQ93468.1__F0
MELPILKTNAITPILAAVTLCFAFSQNITEEFIQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8303 - protein, 574 aa, synthetic construct
  REGION 1..574: note = derived and/or modified protein sequence (wt) from HRSV__AVQ93467.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCENAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8304 - protein, 574 aa, synthetic construct
  REGION 1..574: note = derived and/or modified protein sequence (wt) from HRSV__AVQ93590.1__F0
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAVNNRARREAPQYMDYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8305 - protein, 574 aa, synthetic construct
  REGION 1..574: note = derived and/or modified protein sequence (wt) from HRSV__AVQ93552.1__F0
MELLIHRSSAIFLTLAINALYPTSSQNITEEFYQSTCSAVSRGYLSALRTGWYTSVITIELSNIKETKCNGTDTKVKLIKQELDKYKNAVTELQLLMQNTPAVNNRARREALQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8306 - protein, 574 aa, synthetic construct
  REGION 1..574: note = derived and/or modified protein sequence (wt) from HRSV__AVQ93556.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVNTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8307 - protein, 574 aa, synthetic construct
  REGION 1..574: note = derived and/or modified protein sequence (wt) from HRSV__AVQ93471.1__F0
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTRNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8308 - protein, 574 aa, synthetic construct
  REGION 1..574: note = derived and/or modified protein sequence (wt) from HRSV__AVQ93458.1__F0
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8309 - protein, 574 aa, synthetic construct
  REGION 1..574: note = derived and/or modified protein sequence (wt) from HRSV__AVQ93494.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKIRKRRFLGFLLGVGSAIASGIAVSKVLHLEGEVNKIKSALLSTNKAVVSLSNGISVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8310 - protein, 574 aa, synthetic construct
  REGION 1..574: note = derived and/or modified protein sequence (wt) from HRSV__AVQ93470.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVSKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTANIMITTIIIVIIVILLALIAVGLLLYCKARSTPVTLSKDQLSGINNIAFSN

SEQ ID NO: 8311 - protein, 574 aa, synthetic construct
  REGION 1..574: note = derived and/or modified protein sequence (wt) from HRSV__AVQ93489.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPVVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8312 - protein, 574 aa, synthetic construct
  REGION 1..574: note = derived and/or modified protein sequence (wt) from HRSV__AVQ93542.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNSRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8313 - protein, 574 aa, synthetic construct
  REGION 1..574: note = derived and/or modified protein sequence (wt) from HRSV__AVQ93472.1__F0
MELPILKTNAITTIFAAVTLCFSSSQNITEKFYQSTCSAVSKGYLSALRTGWYTSVITIKLSNIKENKCNGTDAKVKLIKQELHKYKNAVTELQLLMQSTPPANNRARRELPRFMNYTLNNTKNNNVTLIKKRKRTFLGFLLGVGSAIASGIAVSKVLHLQGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8314 - protein, 574 aa, synthetic construct
  REGION 1..574: note = derived and/or modified protein sequence (wt) from HRSV__AVQ93514.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNSRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8315 - protein, 574 aa, synthetic construct
  REGION 1..574: note = derived and/or modified protein sequence (wt) from HRSV__AVQ93485.1__F0
MELPILKTNAITTILAAVTLCFASSQNITEEFYQSTCSAVSKGYLSALRTGWYTSVITIELSNIKENKCNGTDAKVKLIKQELDKYKNAVTKLQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTNEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8316 - protein, 574 aa, synthetic construct
  REGION 1..574: note = derived and/or modified protein sequence (wt) from HRSV__AVQ93533.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKIHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8317 - protein, 574 aa, synthetic construct
  REGION 1..574: note = derived and/or modified protein sequence (wt) from HRSV__AVQ93481.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCTIMTSKTDVSSSVITSIGAIVSWYGKTKCTASNKNRGIIKTFCNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLISCKARSPPVTLSKDQLSGINNIAFSK

SEQ ID NO: 8318 - protein, 574 aa, synthetic construct
  REGION 1..574: note = derived and/or modified protein sequence (wt) from HRSV__AVQ93546.1__F0
MELLIHRSNAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8319 - protein, 574 aa, synthetic construct
  REGION 1..574: note = derived and/or modified protein sequence (wt) from HRSV__AVQ93512.1__F0
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINLYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8320 - protein, 574 aa, synthetic construct
  REGION 1..574: note = derived and/or modified protein sequence (wt) from HRSV__AVQ93554.1__F0
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAVNNRARREAPQYMDYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLMLYCKAKNTPVTLSKDQLSGINNIAFSK

SEQ ID NO: 8321 - protein, 574 aa, synthetic construct
  REGION 1..574: note = derived and/or modified protein sequence (wt) from HRSV__AVQ93551.1__F0
MELLIHRSSAIFLTLAINALYPTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8322 - protein, 574 aa, synthetic construct
  REGION 1..574: note = derived and/or modified protein sequence (wt) from HRSV__AVQ93547.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAINNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8323 - protein, 574 aa, synthetic construct
  REGION 1..574: note = derived and/or modified protein sequence (wt) from HRSV__AVQ93558.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLYVSISKKRKRRFLGFLLGVGSAIASGIAVSKVLHLEGEVNKIKNALQSTNKAVVSLSNGVSVLTSKVLDLKNYINSQLLPIVNKQSCRISNIETVIEFQQKNSRLLEITREFSVNAGVTTPLSTYMLTNSELLSLIIDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8324 - protein, 574 aa, synthetic construct
  REGION 1..574: note = derived and/or modified protein sequence (wt) from HRSV__AVQ93461.1__F0
MESPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8325 - protein, 574 aa, synthetic construct
  REGION 1..574: note = derived and/or modified protein sequence (wt) from HRSV__AVQ93500.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSISFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8326 - protein, 574 aa, synthetic construct
  REGION 1..574: note = derived and/or modified protein sequence (wt) from HRSV__AVQ93426.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLYNVNAGKSTTNIMITTIIIVIIVILLALIAVGLLLYCKARSTPVTLSKDQLSGINNIAFSN

SEQ ID NO: 8327 - protein, 574 aa, synthetic construct
  REGION 1..574: note = derived and/or modified protein sequence (wt) from HRSV__AVQ93398.1__F0
MELPILKINAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8328 - protein, 574 aa, synthetic construct
  REGION 1..574: note = derived and/or modified protein sequence (wt) from HRSV__AVQ93401.1__F0
MELPILKTNAITTILAAVTLYFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8329 - protein, 574 aa, synthetic construct
  REGION 1..574: note = derived and/or modified protein sequence (wt) from HRSV__AVQ93361.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSAPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8330 - protein, 574 aa, synthetic construct
  REGION 1..574: note = derived and/or modified protein sequence (wt) from HRSV__AVQ93408.1__F0
MELPISKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYNPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8331 - protein, 574 aa, synthetic construct
  REGION 1..574: note = derived and/or modified protein sequence (wt) from HRSV__AVQ93443.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8332 - protein, 574 aa, synthetic construct
  REGION 1..574: note = derived and/or modified protein sequence (wt) from HRSV__AVQ93429.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8333 - protein, 574 aa, synthetic construct
  REGION 1..574: note = derived and/or modified protein sequence (wt) from HRSV__AVQ93359.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNVGKSTTNIMITTIIIVIIVILLLLIAVGLFLYCKARSTSVTLSKDQLSGINNIAFSN

SEQ ID NO: 8334 - protein, 574 aa, synthetic construct
  REGION 1..574: note = derived and/or modified protein sequence (wt) from HRSV__AVQ93365.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAVNSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8335 - protein, 574 aa, synthetic construct
  REGION 1..574: note = derived and/or modified protein sequence (wt) from HRSV__AVQ93366.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIIRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8336 - protein, 574 aa, synthetic construct
  REGION 1..574: note = derived and/or modified protein sequence (wt) from HRSV__AVQ93402.1__F0
MELPILKTNTITTILAAVTLCFASSQNITEEFYQSTCSAVSKGYLIALRTGWYTNVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8337 - protein, 574 aa, synthetic construct
  REGION 1..574: note = derived and/or modified protein sequence (wt) from HRSV__AVQ93377.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLFLYCKARSTPVTLSKDQLSGINNIAFSN

SEQ ID NO: 8338 - protein, 574 aa, synthetic construct
  REGION 1..574: note = derived and/or modified protein sequence (wt) from HRSV__AVQ93412.1__F0
MELPILKTNAITIILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTSVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNINIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8339 - protein, 574 aa, synthetic construct
  REGION 1..574: note = derived and/or modified protein sequence (wt) from HRSV__AVQ93391.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVSLSKDQLSGINNIAFSN

SEQ ID NO: 8340 - protein, 574 aa, synthetic construct
  REGION 1..574: note = derived and/or modified protein sequence (wt) from HRSV__AVQ93457.1__F0
MELPILKTNAITTILAAVTLCIASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8341 - protein, 574 aa, synthetic construct
  REGION 1..574: note = derived and/or modified protein sequence (wt) from HRSV__AVQ93372.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYNPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8342 - protein, 574 aa, synthetic construct
  REGION 1..574: note = derived and/or modified protein sequence (wt) from HRSV__AVQ93455.1__F0
MELPIFKTNAITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8343 - protein, 574 aa, synthetic construct
  REGION 1..574: note = derived and/or modified protein sequence (wt) from HRSV__AVQ93364.1__F0
MELPILKTNAITTILAVVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIIRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8344 - protein, 574 aa, synthetic construct
  REGION 1..574: note = derived and/or modified protein sequence (wt) from HRSV__AVQ93378.1__F0
MQLPILKIYAITSILAAVTLYFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8345 - protein, 574 aa, synthetic construct
  REGION 1..574: note = derived and/or modified protein sequence (wt) from HRSV__AVQ93393.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGKPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8346 - protein, 574 aa, synthetic construct
  REGION 1..574: note = derived and/or modified protein sequence (wt) from HRSV__AVQ93362.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQLNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8347 - protein, 574 aa, synthetic construct
  REGION 1..574: note = derived and/or modified protein sequence (wt) from HRSV__AVQ93585.1__F0
MELLIHRSSAIFLTLVINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8348 - protein, 574 aa, synthetic construct
  REGION 1..574: note = derived and/or modified protein sequence (wt) from HRSV__ART28504.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8349 - protein, 574 aa, synthetic construct
  REGION 1..574: note = derived and/or modified protein sequence (wt) from HRSV__AVQ93404.1__F0
MELPISKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8350 - protein, 574 aa, synthetic construct
  REGION 1..574: note = derived and/or modified protein sequence (wt) from HRSV__AOS49123.1__F0
MELPILKTNTITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8351 - protein, 574 aa, synthetic construct
  REGION 1..574: note = derived and/or modified protein sequence (wt) from HRSV__AGN92837.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8352 - protein, 574 aa, synthetic construct
  REGION 1..574: note = derived and/or modified protein sequence (wt) from HRSV__AOS48496.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8353 - protein, 574 aa, synthetic construct
  REGION 1..574: note = derived and/or modified protein sequence (wt) from HRSV__AMT78271.1__F0
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8354 - protein, 574 aa, synthetic construct
  REGION 1..574: note = derived and/or modified protein sequence (wt) from HRSV__AIY62428.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8355 - protein, 574 aa, synthetic construct
  REGION 1..574: note = derived and/or modified protein sequence (wt) from HRSV__AHX57174.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGKPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8356 - protein, 574 aa, synthetic construct
  REGION 1..574: note = derived and/or modified protein sequence (wt) from HRSV__AHW81390.1__F0
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8357 - protein, 574 aa, synthetic construct
  REGION 1..574: note = derived and/or modified protein sequence (wt) from HRSV__AHV81506.1__F0
MELPILKTNAIITILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8358 - protein, 574 aa, synthetic construct
  REGION 1..574: note = derived and/or modified protein sequence (wt) from HRSV__AFX60128.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8359 - protein, 574 aa, synthetic construct
  REGION 1..574: note = derived and/or modified protein sequence (wt) from HRSV__AFX60129.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8360 - protein, 574 aa, synthetic construct
  REGION 1..574: note = derived and/or modified protein sequence (wt) from HRSV__AEQ63389.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8361 - protein, 574 aa, synthetic construct
  REGION 1..574: note = derived and/or modified protein sequence (wt) from HRSV__ARB66328.1__F0
MELPILKTNAITTILAAVTLCFASSQNITEEFYQSTCSAVSKGYLSALRTGWYTSVITIELSNIRENKCNGTDAKVKLIKQELDKYKNAVTELQLLMQSTPAASSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDTSISQVNEKINQSLAFIRKSDELLHNVNAGKSTTNIMITTIIIVIIVILLALIAVGLLLYCKAKSTPVTLSKDQLSGINNIAFSN

SEQ ID NO: 8362 - protein, 574 aa, synthetic construct
  REGION 1..574: note = derived and/or modified protein sequence (wt) from HRSV__ANZ80034.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAASSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8363 - protein, 574 aa, synthetic construct
  REGION 1..574: note = derived and/or modified protein sequence (wt) from HRSV__AMN91253.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8364 - protein, 574 aa, synthetic construct
  REGION 1..574: note = derived and/or modified protein sequence (wt) from HRSV__P03420.1__F0
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8365 - protein, 574 aa, synthetic construct
  REGION 1..574: note = derived and/or modified protein sequence (wt) from HRSV__AIO08046.1__F0
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8366 - protein, 574 aa, synthetic construct
  REGION 1..574: note = derived and/or modified protein sequence (wt) from HRSV__AFX95851.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLGKDQLSGINNIAFNN

SEQ ID NO: 8367 - protein, 574 aa, synthetic construct
  REGION 1..574: note = derived and/or modified protein sequence (wt) from HRSV__NP_056863.1__F0
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8368 - protein, 574 aa, synthetic construct
  REGION 1..574: note = derived and/or modified protein sequence (wt) from HRSV__AFX60234.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8369 - protein, 574 aa, synthetic construct
  REGION 1..574: note = derived and/or modified protein sequence (wt) from HRSV__AFX60231.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTRNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8370 - protein, 574 aa, synthetic construct
  REGION 1..574: note = derived and/or modified protein sequence (wt) from HRSV__AFX60232.1__F0
MELLIYRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8371 - protein, 574 aa, synthetic construct
  REGION 1..574: note = derived and/or modified protein sequence (wt) from HRSV__AFX60222.1__F0
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQICRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8372 - protein, 574 aa, synthetic construct
  REGION 1..574: note = derived and/or modified protein sequence (wt) from HRSV__AFX60219.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITAIIIVIIVVLLSLIAIGLLLYCKAKNTPVTLSKDQLSGINNIAFSK

SEQ ID NO: 8373 - protein, 574 aa, synthetic construct
  REGION 1..574: note = derived and/or modified protein sequence (wt) from HRSV__AFX60215.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8374 - protein, 574 aa, synthetic construct
  REGION 1..574: note = derived and/or modified protein sequence (wt) from HRSV__AFX60214.1__F0
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8375 - protein, 574 aa, synthetic construct
  REGION 1..574: note = derived and/or modified protein sequence (wt) from HRSV__AFX60212.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8376 - protein, 574 aa, synthetic construct
  REGION 1..574: note = derived and/or modified protein sequence (wt) from HRSV__AFX60208.1__F0
MELPILKTNAITTILAAVTLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8377 - protein, 574 aa, synthetic construct
  REGION 1..574: note = derived and/or modified protein sequence (wt) from HRSV__AFX60202.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8378 - protein, 574 aa, synthetic construct
  REGION 1..574: note = derived and/or modified protein sequence (wt) from HRSV__AFX60220.1__F0
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8379 - protein, 574 aa, synthetic construct
  REGION 1..574: note = derived and/or modified protein sequence (wt) from HRSV__AFX60213.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8380 - protein, 574 aa, synthetic construct
  REGION 1..574: note = derived and/or modified protein sequence (wt) from HRSV__AFX60190.1__F0
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8381 - protein, 574 aa, synthetic construct
  REGION 1..574: note = derived and/or modified protein sequence (wt) from HRSV__AFX60187.1__F0
MELPILKTNAITTILAAVTLCFSSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8382 - protein, 574 aa, synthetic construct
  REGION 1..574: note = derived and/or modified protein sequence (wt) from HRSV__AFX60201.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKARSTPVTLSKDQLSGINNIAFSN

SEQ ID NO: 8383 - protein, 574 aa, synthetic construct
  REGION 1..574: note = derived and/or modified protein sequence (wt) from HRSV__AFX60173.1__F0
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTSIMITTIIIVIIVILLSLIAVGLLLYCKARSTPVTLSKDQLSGINNIAFSN

SEQ ID NO: 8384 - protein, 574 aa, synthetic construct
  REGION 1..574: note = derived and/or modified protein sequence (wt) from HRSV__AFX60169.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPSANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8385 - protein, 574 aa, synthetic construct
  REGION 1..574: note = derived and/or modified protein sequence (wt) from HRSV__AFX60162.1__F0
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8386 - protein, 574 aa, synthetic construct
  REGION 1..574: note = derived and/or modified protein sequence (wt) from HRSV__AFX60156.1__F0
MELPILKANAITTILAAVILCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKARSTPVTLSKDQLSGINNIAFSS

SEQ ID NO: 8387 - protein, 574 aa, synthetic construct
  REGION 1..574: note = derived and/or modified protein sequence (wt) from HRSV__AFX60151.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSILNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8388 - protein, 574 aa, synthetic construct
  REGION 1..574: note = derived and/or modified protein sequence (wt) from HRSV__AFX60150.1__F0
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8389 - protein, 574 aa, synthetic construct
  REGION 1..574: note = derived and/or modified protein sequence (wt) from HRSV__AFX60148.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISLVNEKINQSLAFIRKSDELLHNVNAGKSTTNIMITTIIIVIIVILLALIAVGLLLYCKARSTPVTLSKDQLSGINNIAFSN

SEQ ID NO: 8390 - protein, 574 aa, synthetic construct
  REGION 1..574: note = derived and/or modified protein sequence (wt) from HRSV__AFX60127.1__F0
MELPILKANAITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKARSTPVTLSKDQLSGINNIAFSS

SEQ ID NO: 8391 - protein, 574 aa, synthetic construct
  REGION 1..574: note = derived and/or modified protein sequence (wt) from HRSV__AFX60137.1__F0
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNKKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8392 - protein, 574 aa, synthetic construct
  REGION 1..574: note = derived and/or modified protein sequence (wt) from HRSV__AFX60135.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGTAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8393 - protein, 574 aa, synthetic construct
  REGION 1..574: note = derived and/or modified protein sequence (wt) from HRSV__AFV46420.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNFCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8394 - protein, 574 aa, synthetic construct
  REGION 1..574: note = derived and/or modified protein sequence (wt) from HRSV__AFX60200.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKVGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8395 - protein, 574 aa, synthetic construct
  REGION 1..574: note = derived and/or modified protein sequence (wt) from HRSV__AFV46419.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8396 - protein, 574 aa, synthetic construct
  REGION 1..574: note = derived and/or modified protein sequence (wt) from HRSV__AFV46417.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRTRRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8397 - protein, 574 aa, synthetic construct
  REGION 1..574: note = derived and/or modified protein sequence (wt) from HRSV__AFV46413.1__F0
MELPILKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8398 - protein, 574 aa, synthetic construct
  REGION 1..574: note = derived and/or modified protein sequence (wt) from HRSV__AFV46414.1__F0
MELPILKTNAITTILAAITLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8399 - protein, 574 aa, synthetic construct
  REGION 1..574: note = derived and/or modified protein sequence (wt) from HRSV__AFV46410.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPTANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8400 - protein, 574 aa, synthetic construct
  REGION 1..574: note = derived and/or modified protein sequence (wt) from HRSV__AFV46403.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8401 - protein, 574 aa, synthetic construct
  REGION 1..574: note = derived and/or modified protein sequence (wt) from HRSV__AFV46409.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDTSISQVNEKINQSLAFIRKSDELLHNVNAGKSTTNIMITTIIIVIIVILLALIAVGLLLYCKARSTPVTLSKDQLSGINNIAFSN

SEQ ID NO: 8402 - protein, 574 aa, synthetic construct
  REGION 1..574: note = derived and/or modified protein sequence (wt) from HRSV__AFP99061.1__F0
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8403 - protein, 574 aa, synthetic construct
  REGION 1..574: note = derived and/or modified protein sequence (wt) from HRSV__AFM95400.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKNNNVTLSNKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8404 - protein, 574 aa, synthetic construct
  REGION 1..574: note = derived and/or modified protein sequence (wt) from HRSV__AFV46401.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8405 - protein, 574 aa, synthetic construct
  REGION 1..574: note = derived and/or modified protein sequence (wt) from HRSV__AFP99064.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGVAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8406 - protein, 574 aa, synthetic construct
  REGION 1..574: note = derived and/or modified protein sequence (wt) from HRSV__AFM95376.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8407 - protein, 574 aa, synthetic construct
  REGION 1..574: note = derived and/or modified protein sequence (wt) from HRSV__AFX60138.1__F0
MELPILKTNSITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8408 - protein, 574 aa, synthetic construct
  REGION 1..574: note = derived and/or modified protein sequence (wt) from HRSV__AFP99060.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8409 - protein, 574 aa, synthetic construct
  REGION 1..574: note = derived and/or modified protein sequence (wt) from HRSV__AFM95365.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKYDELLHNVNAGKSTTNIMITTIIIVIIVILLSLIAVGLLLYCKARSTPVTLSKDQLSGINNIAFSN

SEQ ID NO: 8410 - protein, 574 aa, synthetic construct
  REGION 1..574: note = derived and/or modified protein sequence (wt) from HRSV__AFM55563.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8411 - protein, 574 aa, synthetic construct
  REGION 1..574: note = derived and/or modified protein sequence (wt) from HRSV__AFM55530.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNSTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQINEKINQSLAFIRKSDELLHNVNAGKSTTNIMITTIIIVIIVILLALIAVGLLLYCKARSTPVTLSKDQLSGINNIAFSN

SEQ ID NO: 8412 - protein, 574 aa, synthetic construct
  REGION 1..574: note = derived and/or modified protein sequence (wt) from HRSV__AFM55442.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKEQLSGINNIAFSN

SEQ ID NO: 8413 - protein, 574 aa, synthetic construct
  REGION 1..574: note = derived and/or modified protein sequence (wt) from HRSV__AFM55420.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPVVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8414 - protein, 574 aa, synthetic construct
  REGION 1..574: note = derived and/or modified protein sequence (wt) from HRSV__AFM55552.1__F0
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8415 - protein, 574 aa, synthetic construct
  REGION 1..574: note = derived and/or modified protein sequence (wt) from HRSV__AFM55365.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKIHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8416 - protein, 574 aa, synthetic construct
  REGION 1..574: note = derived and/or modified protein sequence (wt) from HRSV__AFP99059.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8417 - protein, 574 aa, synthetic construct
  REGION 1..574: note = derived and/or modified protein sequence (wt) from HRSV__AFM55354.1__F0
MELPILKTNAITTILAAVTLCFVSSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8418 - protein, 574 aa, synthetic construct
  REGION 1..574: note = derived and/or modified protein sequence (wt) from HRSV__AFM55343.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNANVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8419 - protein, 574 aa, synthetic construct
  REGION 1..574: note = derived and/or modified protein sequence (wt) from HRSV__AFM55387.1__F0
MELPILKTNAITIILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSAPVTLSKDQLSGINNIAFSN

SEQ ID NO: 8420 - protein, 574 aa, synthetic construct
  REGION 1..574: note = derived and/or modified protein sequence (wt) from HRSV__AFM55299.1__F0
MDLPILKTKAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNNKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8421 - protein, 574 aa, synthetic construct
  REGION 1..574: note = derived and/or modified protein sequence (wt) from HRSV__AFM55288.1__F0
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8422 - protein, 574 aa, synthetic construct
  REGION 1..574: note = derived and/or modified protein sequence (wt) from HRSV__AFM55266.1__F0
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8423 - protein, 574 aa, synthetic construct
  REGION 1..574: note = derived and/or modified protein sequence (wt) from HRSV__AFM55277.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8424 - protein, 574 aa, synthetic construct
  REGION 1..574: note = derived and/or modified protein sequence (wt) from HRSV__AFM55255.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYFKARSTPVTLSKDQLSGINNIAFSN

SEQ ID NO: 8425 - protein, 574 aa, synthetic construct
  REGION 1..574: note = derived and/or modified protein sequence (wt) from HRSV__AFM55222.1__F0
MELPILKTNVITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8426 - protein, 574 aa, synthetic construct
  REGION 1..574: note = derived and/or modified protein sequence (wt) from HRSV__AFM55211.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8427 - protein, 574 aa, synthetic construct
  REGION 1..574: note = derived and/or modified protein sequence (wt) from HRSV__AFM55244.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8428 - protein, 574 aa, synthetic construct
  REGION 1..574: note = derived and/or modified protein sequence (wt) from HRSV__AFI25262.1__F0
MELLIHRSSAIFLTLAINALYLTSSQNITEEFYQSTCSAVSRGYFSALRTGWYTSVITIELSNIKEIKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDSSISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8429 - protein, 574 aa, synthetic construct
  REGION 1..574: note = derived and/or modified protein sequence (wt) from HRSV__AFD34266.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8430 - protein, 574 aa, synthetic construct
  REGION 1..574: note = derived and/or modified protein sequence (wt) from HRSV__AFM55332.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8431 - protein, 574 aa, synthetic construct
  REGION 1..574: note = derived and/or modified protein sequence (wt) from HRSV__AFD34264.1__F0
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNGELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKEQLSGINNIAFSK

SEQ ID NO: 8432 - protein, 574 aa, synthetic construct
  REGION 1..574: note = derived and/or modified protein sequence (wt) from HRSV__AFD34262.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTHMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8433 - protein, 574 aa, synthetic construct
  REGION 1..574: note = derived and/or modified protein sequence (wt) from HRSV__AFD34265.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREASQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8434 - protein, 574 aa, synthetic construct
  REGION 1..574: note = derived and/or modified protein sequence (wt) from HRSV__AFD34261.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFGVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8435 - protein, 574 aa, synthetic construct
  REGION 1..574: note = derived and/or modified protein sequence (wt) from HRSV__AFD34260.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8436 - protein, 574 aa, synthetic construct
  REGION 1..574: note = derived and/or modified protein sequence (wt) from HRSV__AFD34259.1__F0
MELLIYRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8437 - protein, 574 aa, synthetic construct
  REGION 1..574: note = derived and/or modified protein sequence (wt) from HRSV__AEQ63641.1__F0
MELLIHRSSAIFLTLAINAFYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8438 - protein, 574 aa, synthetic construct
  REGION 1..574: note = derived and/or modified protein sequence (wt) from HRSV__AEQ63487.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8439 - protein, 574 aa, synthetic construct
  REGION 1..574: note = derived and/or modified protein sequence (wt) from HRSV__AEQ63520.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8440 - protein, 574 aa, synthetic construct
  REGION 1..574: note = derived and/or modified protein sequence (wt) from HRSV__4CCF_A__F0
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQVLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8441 - protein, 574 aa, synthetic construct
  REGION 1..574: note = derived and/or modified protein sequence (wt) from HRSV__AEQ63334.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8442 - protein, 574 aa, synthetic construct
  REGION 1..574: note = derived and/or modified protein sequence (wt) from HRSV__AEO45949.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSS

SEQ ID NO: 8443 - protein, 574 aa, synthetic construct
  REGION 1..574: note = derived and/or modified protein sequence (wt) from HRSV__AEO45939.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSFIDGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 8444 - protein, 574 aa, synthetic construct
  REGION 1..574: note = derived and/or modified protein sequence (wt) from HRSV__AEQ63312.1__F0
MELPVLKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8445 - protein, 574 aa, synthetic construct
  REGION 1..574: note = derived and/or modified protein sequence (wt) from HRSV__AEQ63586.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8446 - protein, 574 aa, synthetic construct
  REGION 1..574: note = derived and/or modified protein sequence (wt) from HRSV__AEO45919.1__F0
MELPILKINAITTILAAITLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 8447 - protein, 574 aa, synthetic construct
  REGION 1..574: note = derived and/or modified protein sequence (wt) from HRSV__AEO45909.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTVINDQLSGINNIAFSN

SEQ ID NO: 8448 - protein, 574 aa, synthetic construct
  REGION 1..574: note = derived and/or modified protein sequence (wt) from HRSV__AEO45889.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTVIDDYLSGINNISFIY

SEQ ID NO: 8449 - protein, 574 aa, synthetic construct
  REGION 1..574: note = derived and/or modified protein sequence (wt) from HRSV__AEO45879.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8450 - protein, 574 aa, synthetic construct
  REGION 1..574: note = derived and/or modified protein sequence (wt) from HRSV__AEO45869.1__F0
MELPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTLSKDQLSGINNIAFSN

SEQ ID NO: 8451 - protein, 574 aa, synthetic construct
  REGION 1..574: note = derived and/or modified protein sequence (wt) from HRSV__AEO45929.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8452 - protein, 574 aa, synthetic construct
  REGION 1..574: note = derived and/or modified protein sequence (wt) from HRSV__AEO45850.1__F0
MELPILKTNAITTILTAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTLSKDQLSGINNIAFSN

SEQ ID NO: 8453 - protein, 574 aa, synthetic construct
  REGION 1..574: note = derived and/or modified protein sequence (wt) from HRSV__AEO45859.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8454 - protein, 574 aa, synthetic construct
  REGION 1..574: note = derived and/or modified protein sequence (wt) from HRSV__AEQ63444.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8455 - protein, 574 aa, synthetic construct
  REGION 1..574: note = derived and/or modified protein sequence (wt) from HRSV__AEO23054.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSTSKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8456 - protein, 574 aa, synthetic construct
  REGION 1..574: note = derived and/or modified protein sequence (wt) from HRSV__AEO23052.1__F0
MELPILKANAISTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8457 - protein, 574 aa, synthetic construct
  REGION 1..574: note = derived and/or modified protein sequence (wt) from HRSV__AEO45830.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8458 - protein, 574 aa, synthetic construct
  REGION 1..574: note = derived and/or modified protein sequence (wt) from HRSV__AEO45840.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTVSKDQLSGINNIAFSN

SEQ ID NO: 8459 - protein, 574 aa, synthetic construct
  REGION 1..574: note = derived and/or modified protein sequence (wt) from HRSV__AEO23051.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8460 - protein, 574 aa, synthetic construct
  REGION 1..574: note = derived and/or modified protein sequence (wt) from HRSV__AEC32087.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8461 - protein, 574 aa, synthetic construct
  REGION 1..574: note = derived and/or modified protein sequence (wt) from HRSV__ADZ95785.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKELMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8462 - protein, 574 aa, synthetic construct
  REGION 1..574: note = derived and/or modified protein sequence (wt) from HRSV__AEC32085.1__F0
MELPILKTNAITTILAAVTLCFASSQNITEEFYQSTCSAVSKGYLSALRTGWYTSVITIELSTIKENKCNGTDAKGKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTKIMITTIIIVIIVILLSLIAVGLLLYCKARSTPVTLSKDQLSGINNIAFSS

SEQ ID NO: 8463 - protein, 574 aa, synthetic construct
  REGION 1..574: note = derived and/or modified protein sequence (wt) from HRSV__ADZ95784.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKQLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8464 - protein, 574 aa, synthetic construct
  REGION 1..574: note = derived and/or modified protein sequence (wt) from HRSV__ADZ95783.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKTLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8465 - protein, 574 aa, synthetic construct
  REGION 1..574: note = derived and/or modified protein sequence (wt) from HRSV__ADZ95782.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKMLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8466 - protein, 574 aa, synthetic construct
  REGION 1..574: note = derived and/or modified protein sequence (wt) from HRSV__ADZ95781.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKNLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8467 - protein, 574 aa, synthetic construct
  REGION 1..574: note = derived and/or modified protein sequence (wt) from HRSV__ADZ95778.1__F0
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMFNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8468 - protein, 574 aa, synthetic construct
  REGION 1..574: note = derived and/or modified protein sequence (wt) from HRSV__ACY68435.1__F0
MELPILKTNAITTILAAVTLCFASSQNITEEFYQSTCSAVSKGYLSALRTGWYTSVITIELSTIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8469 - protein, 574 aa, synthetic construct
  REGION 1..574: note = derived and/or modified protein sequence (wt) from HRSV__ACO83302.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8470 - protein, 574 aa, synthetic construct
  REGION 1..574: note = derived and/or modified protein sequence (wt) from HRSV__ABI35685.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKADVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8471 - protein, 574 aa, synthetic construct
  REGION 1..574: note = derived and/or modified protein sequence (wt) from HRSV__AFI25251.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8472 - protein, 574 aa, synthetic construct
  REGION 1..574: note = derived and/or modified protein sequence (wt) from HRSV__AAX23994.1__F0
MELPILKANAITTILAAVTFCFASSQNITEEFYQSTCSAVSKGYLSALRTGWYTSVITIELSNIKENKCNGTDAKVKLINQELDKYKNAVTELQLLMQSTTAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8473 - protein, 574 aa, synthetic construct
  REGION 1..574: note = derived and/or modified protein sequence (wt) from HRSV__AAQ97026.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYGCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8474 - protein, 574 aa, synthetic construct
  REGION 1..574: note = derived and/or modified protein sequence (wt) from HRSV__AAR14266.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLTQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKSYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8475 - protein, 574 aa, synthetic construct
  REGION 1..574: note = derived and/or modified protein sequence (wt) from HRSV__AAQ97027.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCRIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8476 - protein, 574 aa, synthetic construct
  REGION 1..574: note = derived and/or modified protein sequence (wt) from HRSV__AAQ97030.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGAGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8477 - protein, 574 aa, synthetic construct
  REGION 1..574: note = derived and/or modified protein sequence (wt) from HRSV__AAQ97028.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFEASISQVNEKINQSLAFIRKSDELLHHVNAGKSTTNIMITTIIIVIIVILLSLIAVGLLLYCKARSTPVTLSKDQLSGINNIAFSN

SEQ ID NO: 8478 - protein, 574 aa, synthetic construct
  REGION 1..574: note = derived and/or modified protein sequence (wt) from HRSV__AAC57027.1__F0
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8479 - protein, 574 aa, synthetic construct
  REGION 1..574: note = derived and/or modified protein sequence (wt) from HRSV__AAQ97029.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGLLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8480 - protein, 574 aa, synthetic construct
  REGION 1..574: note = derived and/or modified protein sequence (wt) from HRSV__AAQ97031.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8481 - protein, 574 aa, synthetic construct
  REGION 1..574: note = derived and/or modified protein sequence (wt) from HRSV__AAM68160.1__F0
MDLPILKTNAITTILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8482 - protein, 574 aa, synthetic construct
  REGION 1..574: note = derived and/or modified protein sequence (wt) from HRSV__AAM44851.1__F0
MELPILKANAITTILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8483 - protein, 574 aa, synthetic construct
  REGION 1..574: note = derived and/or modified protein sequence (wt) from HRSV__P11209.2__F0
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKDRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8484 - protein, 574 aa, synthetic construct
  REGION 1..574: note = derived and/or modified protein sequence (wt) from HRSV__P13843.1__F0
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8485 - protein, 574 aa, synthetic construct
  REGION 1..574: note = derived and/or modified protein sequence (wt) from HRSV__AAO72325.1__F0
MELPILKTNAITTILAAVTLCFASSQNITEEFYQSTCSAVSKGYLSALRTGWYTSVITIELSNIKENKCNGTDAKAKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLHLKNYIDKQFLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSS

SEQ ID NO: 8486 - protein, 574 aa, synthetic construct
  REGION 1..574: note = derived and/or modified protein sequence (wt) from HRSV__AAM68157.1__F0
MDLPILKTNAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8487 - protein, 574 aa, synthetic construct
  REGION 1..574: note = derived and/or modified protein sequence (wt) from HRSV__CAA26143.1__F0
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8488 - protein, 574 aa, synthetic construct
  REGION 1..574: note = derived and/or modified protein sequence (wt) from HRSV__1512372A__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVDKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8489 - protein, 574 aa, synthetic construct
  REGION 1..574: note = derived and/or modified protein sequence (wt) from HRSV__AAB86664.1__F0
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 8490 - protein, 574 aa, synthetic construct
  REGION 1..574: note = derived and/or modified protein sequence (wt) from HRSV__AAO72324.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPFDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 8491 - protein, 574 aa, synthetic construct
  REGION 1..574: note = derived and/or modified protein sequence (wt) from HRSV__AAB82446.1__F0
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIGTVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8492 - protein, 574 aa, synthetic construct
  REGION 1..574: note = derived and/or modified protein sequence (wt) from HRSV__AAO72323.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 8493 - protein, 574 aa, synthetic construct
  REGION 1..574: note = derived and/or modified protein sequence (wt) from HRSV__AAM68154.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSISFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLCVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8494 - protein, 574 aa, synthetic construct
  REGION 1..574: note = derived and/or modified protein sequence (wt) from HRSV__AAA47410.1__F0
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8495 - protein, 574 aa, synthetic construct
  REGION 1..574: note = derived and/or modified protein sequence (wt) from HRSV__P12568.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8496 - protein, 574 aa, synthetic construct
  REGION 1..574: note = derived and/or modified protein sequence (wt) from HRSV__ARB07894.1__F0
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMYSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8497 - protein, 574 aa, synthetic construct
  REGION 1..574: note = derived and/or modified protein sequence (wt) from HRSV__AGG39517.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8498 - protein, 574 aa, synthetic construct
  REGION 1..574: note = derived and/or modified protein sequence (wt) from HRSV__BBC54612.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKIQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8499 - protein, 574 aa, synthetic construct
  REGION 1..574: note = derived and/or modified protein sequence (wt) from HRSV__BBC54636.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRLMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8500 - protein, 574 aa, synthetic construct
  REGION 1..574: note = derived and/or modified protein sequence (wt) from HRSV__BBC54627.1__F0
MELPILKTNAITTILAAVTLCFASSQNITEEFYQSTCSAVSKGYLSALRTGWYTGVITIELSNIKENKCNGTDAKVKLIKQELDKYKNAVTELQLLMQSTPAANSRARRELPRFMNYTLNNTKSTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8501 - protein, 574 aa, synthetic construct
  REGION 1..574: note = derived and/or modified protein sequence (wt) from HRSV__BBC54621.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQTNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8502 - protein, 574 aa, synthetic construct
  REGION 1..574: note = derived and/or modified protein sequence (wt) from HRSV__BBC54570.1__F0
MELPILKTNAITTILASVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8503 - protein, 574 aa, synthetic construct
  REGION 1..574: note = derived and/or modified protein sequence (wt) from HRSV__BBC54579.1__F0
MELPIFKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8504 - protein, 574 aa, synthetic construct
  REGION 1..574: note = derived and/or modified protein sequence (wt) from HRSV__BBC54595.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIVVGLLLYCKARSTPVTLSKDQLSGINNIAFSN

SEQ ID NO: 8505 - protein, 574 aa, synthetic construct
  REGION 1..574: note = derived and/or modified protein sequence (wt) from HRSV__BBC54555.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLGKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINLYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8506 - protein, 574 aa, synthetic construct
  REGION 1..574: note = derived and/or modified protein sequence (wt) from HRSV__BBC54552.1__F0
MELPILKTNAITTILAAVALCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8507 - protein, 574 aa, synthetic construct
  REGION 1..574: note = derived and/or modified protein sequence (wt) from HRSV__BBC54564.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSIRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8508 - protein, 574 aa, synthetic construct
  REGION 1..574: note = derived and/or modified protein sequence (wt) from HRSV__BBC54581.1__F0
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTSVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8509 - protein, 574 aa, synthetic construct
  REGION 1..574: note = derived and/or modified protein sequence (wt) from HRSV__BBC54571.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRLMNYTLKNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8510 - protein, 574 aa, synthetic construct
  REGION 1..574: note = derived and/or modified protein sequence (wt) from HRSV__BBC54553.1__F0
MELLILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIIILLALIAVGLLLYCKARSTPVTLSKDQLSGINNIAFSN

SEQ ID NO: 8511 - protein, 574 aa, synthetic construct
  REGION 1..574: note = derived and/or modified protein sequence (wt) from HRSV__BBC54565.1__F0
MELPILKTNAITTILAAVTLCFASSQNITEEFYQSTCSAVSKGYLSALRTGWYTSVITIELSNIKENKCNGTDAKVKLIKQELDKYKNAVTELQMLMQSTPAANSRARRELPRFMNYTLNNTKNTNVTLSKKRKRRFLGFLLGVGSAIASGIAVSKVLHLEGEVNKIKSALLSTNKAAVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8512 - protein, 574 aa, synthetic construct
  REGION 1..574: note = derived and/or modified protein sequence (wt) from HRSV__BBC54245.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLQLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIIQPTIIIVIIVILLALIAVGLLLYCKARSTPVTLSKDQLSGINNIAFSN

SEQ ID NO: 8513 - protein, 574 aa, synthetic construct
  REGION 1..574: note = derived and/or modified protein sequence (wt) from HRSV__BBC54243.1__F0
MELPILKTNAITTILAAVTLCFASGQNITEEFYQSTCSAVSKGYLSALRTGWYTSVITIELSNIKENKCNGTDAKVKLIKQELDKYKNAVTELQLLMQSTPAASSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8514 - protein, 574 aa, synthetic construct
  REGION 1..574: note = derived and/or modified protein sequence (wt) from HRSV__BBC54238.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKKEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8515 - protein, 574 aa, synthetic construct
  REGION 1..574: note = derived and/or modified protein sequence (wt) from HRSV__BBC54242.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQINEKINQSLAFIRKSDELLHNVNAGKSTTNIMITTIIIVIIVILLALIAVGLLLYCKARSTPVTLSKDQLSGINNIAFSN

SEQ ID NO: 8516 - protein, 574 aa, synthetic construct
  REGION 1..574: note = derived and/or modified protein sequence (wt) from HRSV__BBC54239.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEYQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8517 - protein, 574 aa, synthetic construct
  REGION 1..574: note = derived and/or modified protein sequence (wt) from HRSV__BBC54235.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPVANSRARRELPRFMNYTLNDTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8518 - protein, 574 aa, synthetic construct
  REGION 1..574: note = derived and/or modified protein sequence (wt) from HRSV__BBC54234.1__F0
MELPILKTNAITTILAAVTFCFAFSQNITEEFYQSTCSAVSKGYLSALRTGWYTSVITIELSNIKENKCNGTDAKVKLIKQDLDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8519 - protein, 574 aa, synthetic construct
  REGION 1..574: note = derived and/or modified protein sequence (wt) from HRSV__BBC54236.1__F0
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKARSTPVTLSKDQLSGINNIAFSN

SEQ ID NO: 8520 - protein, 574 aa, synthetic construct
  REGION 1..574: note = derived and/or modified protein sequence (wt) from HRSV__BBC54244.1__F0
MELPILKTNAITTILAAVTLCFASSQNITEEFYQSTCSAVSKGYLSALRTGWYTSVITIELSNIKENKCNGTDAKVKLIKQELDKYKNAVTEVQLLMQSTPADNSRARKEQPRFIDYTLNNTKNTNVTLSKKRKRRFLGFLLGVGSAIASGIAVSKVMHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8521 - protein, 574 aa, synthetic construct
  REGION 1..574: note = derived and/or modified protein sequence (wt) from HRSV__BBC54186.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIREEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8522 - protein, 574 aa, synthetic construct
  REGION 1..574: note = derived and/or modified protein sequence (wt) from HRSV__BBC54178.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKDTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8523 - protein, 574 aa, synthetic construct
  REGION 1..574: note = derived and/or modified protein sequence (wt) from HRSV__BBC54202.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLHYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8524 - protein, 574 aa, synthetic construct
  REGION 1..574: note = derived and/or modified protein sequence (wt) from HRSV__BBC54151.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPVVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8525 - protein, 574 aa, synthetic construct
  REGION 1..574: note = derived and/or modified protein sequence (wt) from HRSV__BBC54142.1__F0
MELPILKTNAITTILAAITLCFASSQNITEEFFQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8526 - protein, 574 aa, synthetic construct
  REGION 1..574: note = derived and/or modified protein sequence (wt) from HRSV__BBC54134.1__F0
MDLPILKTNAITTILAAVTLCFTSSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8527 - protein, 574 aa, synthetic construct
  REGION 1..574: note = derived and/or modified protein sequence (wt) from HRSV__BBC54170.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKARSTPVTLSKDQLSGINNIAFSN

SEQ ID NO: 8528 - protein, 574 aa, synthetic construct
  REGION 1..574: note = derived and/or modified protein sequence (wt) from HRSV__BBC54210.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPVANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8529 - protein, 574 aa, synthetic construct
  REGION 1..574: note = derived and/or modified protein sequence (wt) from HRSV__BBC54169.1__F0
MELPILKTNAITTILAVVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8530 - protein, 574 aa, synthetic construct
  REGION 1..574: note = derived and/or modified protein sequence (wt) from HRSV__BBC54213.1__F0
MELPILKTNAITTILAAVTFCFAFSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8531 - protein, 574 aa, synthetic construct
  REGION 1..574: note = derived and/or modified protein sequence (wt) from HRSV__BBC54203.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8532 - protein, 574 aa, synthetic construct
  REGION 1..574: note = derived and/or modified protein sequence (wt) from HRSV__BBC54160.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNASKSTTNIMITTIIIVIIVILLALIAVGLLLYCKARSTPVTLSKDQLSGINNIAFSN

SEQ ID NO: 8533 - protein, 574 aa, synthetic construct
  REGION 1..574: note = derived and/or modified protein sequence (wt) from HRSV__BBC54163.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKVVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKARSTPVTLSKDQLSGINNIAFSN

SEQ ID NO: 8534 - protein, 574 aa, synthetic construct
  REGION 1..574: note = derived and/or modified protein sequence (wt) from HRSV__BBC54215.1__F0
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAIGLLLYCKARSTPVTLSKDQLSGINNIAFSN

SEQ ID NO: 8535 - protein, 574 aa, synthetic construct
  REGION 1..574: note = derived and/or modified protein sequence (wt) from HRSV__BBC54156.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPVTNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPITLSKDQLSGINNIAFSN

SEQ ID NO: 8536 - protein, 574 aa, synthetic construct
  REGION 1..574: note = derived and/or modified protein sequence (wt) from HRSV__BBC54179.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQLNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKGRSTPVTLSKDQLRGINNIAFSN

SEQ ID NO: 8537 - protein, 574 aa, synthetic construct
  REGION 1..574: note = derived and/or modified protein sequence (wt) from HRSV__BBC54150.1__F0
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8538 - protein, 574 aa, synthetic construct
  REGION 1..574: note = derived and/or modified protein sequence (wt) from HRSV__BBC54207.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLDNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8539 - protein, 574 aa, synthetic construct
  REGION 1..574: note = derived and/or modified protein sequence (wt) from HRSV__BBC54194.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMYYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8540 - protein, 574 aa, synthetic construct
  REGION 1..574: note = derived and/or modified protein sequence (wt) from HRSV__BBC54149.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNHKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8541 - protein, 574 aa, synthetic construct
  REGION 1..574: note = derived and/or modified protein sequence (wt) from HRSV__BBC54138.1__F0
MDLPILKTNAITTILAAVTLCFASSQNITEEFYQSTCSAISKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8542 - protein, 574 aa, synthetic construct
  REGION 1..574: note = derived and/or modified protein sequence (wt) from HRSV__BBC54199.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSATASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGETKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKARSTPVTLSKDQLSGINNIAFSN

SEQ ID NO: 8543 - protein, 574 aa, synthetic construct
  REGION 1..574: note = derived and/or modified protein sequence (wt) from HRSV__BBC54220.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNVMITTIIIVIIVILLALIAVGLLLYCKARSTPVTLSKDQLSGINNIAFSN

SEQ ID NO: 8544 - protein, 574 aa, synthetic construct
  REGION 1..574: note = derived and/or modified protein sequence (wt) from HRSV__BBC54181.1__F0
MELPIIKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8545 - protein, 574 aa, synthetic construct
  REGION 1..574: note = derived and/or modified protein sequence (wt) from HRSV__BBC54132.1__F0
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKIKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8546 - protein, 574 aa, synthetic construct
  REGION 1..574: note = derived and/or modified protein sequence (wt) from HRSV__BBC54146.1__F0
MELPILKTNAITTILATVTLCFASSQNITEEFYQSTCSAVSKGYLSALRTGWYTSVITIELSNIKKNKCNGTDAKVKLIKQELDKYKNAVTELQLLMQSTPAANSRARRELPRFINYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8547 - protein, 574 aa, synthetic construct
  REGION 1..574: note = derived and/or modified protein sequence (wt) from HRSV__BBC54122.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLIFPSDEFDASISQVNEKINQSLAFIRKSDELLHNINAGKSTTNIMITTIIIVIVVILLSLIAVGLLLYCKARSTPVTLSKDQLSGINNIAFSS

SEQ ID NO: 8548 - protein, 574 aa, synthetic construct
  REGION 1..574: note = derived and/or modified protein sequence (wt) from HRSV__BBC54124.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSSTNIMITTIIIVIVVILLSLIAVGLLLYCKARSTPVTLSKDQLSGINNIAFSS

SEQ ID NO: 8549 - protein, 574 aa, synthetic construct
  REGION 1..574: note = derived and/or modified protein sequence (wt) from HRSV__BBB35202.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8550 - protein, 574 aa, synthetic construct
  REGION 1..574: note = derived and/or modified protein sequence (wt) from HRSV__BBB35201.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLSFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8551 - protein, 574 aa, synthetic construct
  REGION 1..574: note = derived and/or modified protein sequence (wt) from HRSV__BBB35192.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLYNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8552 - protein, 574 aa, synthetic construct
  REGION 1..574: note = derived and/or modified protein sequence (wt) from HRSV__BBB35193.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFRNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8553 - protein, 574 aa, synthetic construct
  REGION 1..574: note = derived and/or modified protein sequence (wt) from HRSV__BBB35204.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKGQLSGINNIAFSS

SEQ ID NO: 8554 - protein, 574 aa, synthetic construct
  REGION 1..574: note = derived and/or modified protein sequence (wt) from HRSV__BBB35199.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSLSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8555 - protein, 574 aa, synthetic construct
  REGION 1..574: note = derived and/or modified protein sequence (wt) from HRSV__BBB35184.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8556 - protein, 574 aa, synthetic construct
  REGION 1..574: note = derived and/or modified protein sequence (wt) from HRSV__BBB35126.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQLNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8557 - protein, 574 aa, synthetic construct
  REGION 1..574: note = derived and/or modified protein sequence (wt) from HRSV__BBB35133.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQSETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8558 - protein, 574 aa, synthetic construct
  REGION 1..574: note = derived and/or modified protein sequence (wt) from HRSV__BBB35130.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8559 - protein, 574 aa, synthetic construct
  REGION 1..574: note = derived and/or modified protein sequence (wt) from HRSV__BBB35160.1__F0
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFTNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIVVGLLLYCKARSTPVTLSKDQLSGINNIAFSS

SEQ ID NO: 8560 - protein, 574 aa, synthetic construct
  REGION 1..574: note = derived and/or modified protein sequence (wt) from HRSV__BBB35162.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLTTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLTFIRKSDELLHNVNVGKSTTNIMITTIIIVIIVILLLLIAVGLFLYCKARSTPVTLSKDQLSGINNIAFSN

SEQ ID NO: 8561 - protein, 574 aa, synthetic construct
  REGION 1..574: note = derived and/or modified protein sequence (wt) from HRSV__BBB35181.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNTRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSITNIMITTIIIVIIVILLSLIAVGLLLYCKARSTPVTLSKDQLSGINNIAFSN

SEQ ID NO: 8562 - protein, 574 aa, synthetic construct
  REGION 1..574: note = derived and/or modified protein sequence (wt) from HRSV__BBB35165.1__F0
MDLPILKTNAITAIFAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8563 - protein, 574 aa, synthetic construct
  REGION 1..574: note = derived and/or modified protein sequence (wt) from HRSV__BBB35121.1__F0
MELPILKTNAITTILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8564 - protein, 574 aa, synthetic construct
  REGION 1..574: note = derived and/or modified protein sequence (wt) from HRSV__BBB35173.1__F0
MDLPILKTNAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVKLSKDQLSGINNIAFSN

SEQ ID NO: 8565 - protein, 574 aa, synthetic construct
  REGION 1..574: note = derived and/or modified protein sequence (wt) from HRSV__BBB35138.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8566 - protein, 574 aa, synthetic construct
  REGION 1..574: note = derived and/or modified protein sequence (wt) from HRSV__BBB35176.1__F0
MDLPILKTNAITAILAAVSLCFASSQNITEEFYQSTCSAVSKGYLSALRTGWYTSVITIELSNIKENKCNGTDTKVKLIKQELDKYKNAVTELQLLMQSTPAANNRARRELPRFMNHTLNNTKDNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8567 - protein, 574 aa, synthetic construct
  REGION 1..574: note = derived and/or modified protein sequence (wt) from HRSV__BBB35142.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKNTNVTVSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8568 - protein, 574 aa, synthetic construct
  REGION 1..574: note = derived and/or modified protein sequence (wt) from HRSV__BBB35136.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8569 - protein, 574 aa, synthetic construct
  REGION 1..574: note = derived and/or modified protein sequence (wt) from HRSV__BBB35153.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGITKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8570 - protein, 574 aa, synthetic construct
  REGION 1..574: note = derived and/or modified protein sequence (wt) from HRSV__BBB35115.1__F0
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8571 - protein, 574 aa, synthetic construct
  REGION 1..574: note = derived and/or modified protein sequence (wt) from HRSV__BBB35150.1__F0
MDLPILKTNAITTILATVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8572 - protein, 574 aa, synthetic construct
  REGION 1..574: note = derived and/or modified protein sequence (wt) from HRSV__BBB35097.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8573 - protein, 574 aa, synthetic construct
  REGION 1..574: note = derived and/or modified protein sequence (wt) from HRSV__BBB35109.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGMLLYCKARSTPVTLSKDQLSGINNIAFSS

SEQ ID NO: 8574 - protein, 574 aa, synthetic construct
  REGION 1..574: note = derived and/or modified protein sequence (wt) from HRSV__BBB35094.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQLNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8575 - protein, 574 aa, synthetic construct
  REGION 1..574: note = derived and/or modified protein sequence (wt) from HRSV__BBB35183.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNTRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKVMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8576 - protein, 574 aa, synthetic construct
  REGION 1..574: note = derived and/or modified protein sequence (wt) from HRSV__BBB35104.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGMLLYCKARSTPVTLSKDQLSGINNIAFSS

SEQ ID NO: 8577 - protein, 574 aa, synthetic construct
  REGION 1..574: note = derived and/or modified protein sequence (wt) from HRSV__BBB35099.1__F0
MELPILKTNAITTILAAVTLCFASSQNITEEFYQSTCSAVSKGYLSALRTGWYTSVITIELSNIKENKCNGTDSKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8578 - protein, 574 aa, synthetic construct
  REGION 1..574: note = derived and/or modified protein sequence (wt) from HRSV__BBB35188.1__F0
MDLPILKTNAITAILAAVSLYFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNSKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8579 - protein, 574 aa, synthetic construct
  REGION 1..574: note = derived and/or modified protein sequence (wt) from HRSV__AKA45871.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8580 - protein, 574 aa, synthetic construct
  REGION 1..574: note = derived and/or modified protein sequence (wt) from HRSV__ASV65838.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8581 - protein, 574 aa, synthetic construct
  REGION 1..574: note = derived and/or modified protein sequence (wt) from HRSV__AGG39373.1__F0
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8582 - protein, 574 aa, synthetic construct
  REGION 1..574: note = derived and/or modified protein sequence (wt) from HRSV__AII22107.1__F0
MELLILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8583 - protein, 574 aa, synthetic construct
  REGION 1..574: note = derived and/or modified protein sequence (wt) from HRSV__AGG39400.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8584 - protein, 574 aa, synthetic construct
  REGION 1..574: note = derived and/or modified protein sequence (wt) from HRSV__AHY21375.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8585 - protein, 574 aa, synthetic construct
  REGION 1..574: note = derived and/or modified protein sequence (wt) from HRSV__AGG39457.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8586 - protein, 574 aa, synthetic construct
  REGION 1..574: note = derived and/or modified protein sequence (wt) from HRSV__ARR29240.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYIINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8587 - protein, 574 aa, synthetic construct
  REGION 1..574: note = derived and/or modified protein sequence (wt) from HRSV__ARR29251.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFVNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8588 - protein, 574 aa, synthetic construct
  REGION 1..574: note = derived and/or modified protein sequence (wt) from HRSV__ARR29189.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLDNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8589 - protein, 574 aa, synthetic construct
  REGION 1..574: note = derived and/or modified protein sequence (wt) from HRSV__ARR29207.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNEQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8590 - protein, 574 aa, synthetic construct
  REGION 1..574: note = derived and/or modified protein sequence (wt) from HRSV__AUH15164.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGETKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8591 - protein, 574 aa, synthetic construct
  REGION 1..574: note = derived and/or modified protein sequence (wt) from HRSV__ATV81343.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8592 - protein, 574 aa, synthetic construct
  REGION 1..574: note = derived and/or modified protein sequence (wt) from HRSV__AUC68654.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLFLYCKARSTPVTLSKDQLSGINNIAFSN

SEQ ID NO: 8593 - protein, 574 aa, synthetic construct
  REGION 1..574: note = derived and/or modified protein sequence (wt) from HRSV__AUC68577.1__F0
MELMIHKSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQYMNYTVNTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGDPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8594 - protein, 574 aa, synthetic construct
  REGION 1..574: note = derived and/or modified protein sequence (wt) from HRSV__AUC68566.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSNELLHNVNAGKSTTNIMITTIIIVIIVILLSLIAVGLLLYCKARSTPVTLSKDQLSGINNIAFSN

SEQ ID NO: 8595 - protein, 574 aa, synthetic construct
  REGION 1..574: note = derived and/or modified protein sequence (wt) from HRSV__AUC68555.1__F0
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8596 - protein, 574 aa, synthetic construct
  REGION 1..574: note = derived and/or modified protein sequence (wt) from HRSV__AUC68478.1__F0
MELLIHRSSAIFLTLAINALYLTSSQNITEEFYQSTCSAVSRGYFSALRTGWYTSVITIELSNIKETKCNGTDTKAKLIKQELDKYKNAVTELQLLMQNTPAANNRARREAPQYMNYTVNTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8597 - protein, 574 aa, synthetic construct
  REGION 1..574: note = derived and/or modified protein sequence (wt) from HRSV__AUC68445.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMSYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIVVGLLLYCKARSTPVTLSKDQLSGINNIAFSN

SEQ ID NO: 8598 - protein, 574 aa, synthetic construct
  REGION 1..574: note = derived and/or modified protein sequence (wt) from HRSV__AUC68500.1__F0
MELMIHKSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8599 - protein, 574 aa, synthetic construct
  REGION 1..574: note = derived and/or modified protein sequence (wt) from HRSV__AUC68522.1__F0
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTHCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPITLSKDQLSGINNIAFSN

SEQ ID NO: 8600 - protein, 574 aa, synthetic construct
  REGION 1..574: note = derived and/or modified protein sequence (wt) from HRSV__AUC68291.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTITIVITVILLLLIAVGLFLYCKARSTPVTLSKDQLSGINNIAFSN

SEQ ID NO: 8601 - protein, 574 aa, synthetic construct
  REGION 1..574: note = derived and/or modified protein sequence (wt) from HRSV__AUC68149.1__F0
MELPILKTNAITTILAAVTLCFASSQNITEEFYQSTCSAVSKGYFSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8602 - protein, 574 aa, synthetic construct
  REGION 1..574: note = derived and/or modified protein sequence (wt) from HRSV__AUC68094.1__F0
MELPILKTNAITTILAAVTLCFASSQNITEEFYQATCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVPHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8603 - protein, 574 aa, synthetic construct
  REGION 1..574: note = derived and/or modified protein sequence (wt) from HRSV__AMA67097.1__F0
MELLIHRSSAVFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCRAKNTPVTLSKDQLSGINNIAFSK

SEQ ID NO: 8604 - protein, 574 aa, synthetic construct
  REGION 1..574: note = derived and/or modified protein sequence (wt) from HRSV__AMA66866.1__F0
MELPILKTNAITTILATVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8605 - protein, 574 aa, synthetic construct
  REGION 1..574: note = derived and/or modified protein sequence (wt) from HRSV__AMA66580.1__F0
MELPILKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8606 - protein, 574 aa, synthetic construct
  REGION 1..574: note = derived and/or modified protein sequence (wt) from HRSV__AIZ95750.1__F0
MELLIHRSSAIFLTIAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8607 - protein, 574 aa, synthetic construct
  REGION 1..574: note = derived and/or modified protein sequence (wt) from HRSV__AIZ95541.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLFLYCKARSTPVTLSKDQLSGINNIAFSN

SEQ ID NO: 8608 - protein, 574 aa, synthetic construct
  REGION 1..574: note = derived and/or modified protein sequence (wt) from HRSV__AIZ95519.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8609 - protein, 574 aa, synthetic construct
  REGION 1..574: note = derived and/or modified protein sequence (wt) from HRSV__AHY21419.1__F0
MELPILKTNAITTILAAVTLCFASSQNITEEFYQATCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8610 - protein, 574 aa, synthetic construct
  REGION 1..574: note = derived and/or modified protein sequence (wt) from HRSV__AHY21331.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8611 - protein, 574 aa, synthetic construct
  REGION 1..574: note = derived and/or modified protein sequence (wt) from HRSV__AHY21165.1__F0
MELMIHKSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGDPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8612 - protein, 574 aa, synthetic construct
  REGION 1..574: note = derived and/or modified protein sequence (wt) from HRSV__AHY21143.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8613 - protein, 574 aa, synthetic construct
  REGION 1..574: note = derived and/or modified protein sequence (wt) from HRSV__AHY21132.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8614 - protein, 574 aa, synthetic construct
  REGION 1..574: note = derived and/or modified protein sequence (wt) from HRSV__AGG39478.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8615 - protein, 574 aa, synthetic construct
  REGION 1..574: note = derived and/or modified protein sequence (wt) from HRSV__ATV93506.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNATLSKKRKRRFLGFLLGVGSAIASGIAVSKVLHLEGEVNKIKSALLSTNKAVVSLSNGVSVLTSKVLDLKNYIDKQLLPIVNKQSCSISNIETVMEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8616 - protein, 574 aa, synthetic construct
  REGION 1..574: note = derived and/or modified protein sequence (wt) from HRSV__ATV93509.1__F0
MELPILKTNAITTILAAVILCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8617 - protein, 574 aa, synthetic construct
  REGION 1..574: note = derived and/or modified protein sequence (wt) from HRSV__AIZ95717.1__F0
MELPTIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRVMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8618 - protein, 574 aa, synthetic construct
  REGION 1..574: note = derived and/or modified protein sequence (wt) from HRSV__ATV81354.1__F0
MDLPILKTNAITTILATVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8619 - protein, 574 aa, synthetic construct
  REGION 1..574: note = derived and/or modified protein sequence (wt) from HRSV__ART28317.1__F0
MELPILKTNAITTIFAAVTLCFASSQNITEEFYQSTCSAVSKGYLSALRTGWYTSVITIELSNIKENKCNGTDTKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIGTVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPKAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPITLSKDQLSGINNIAFSN

SEQ ID NO: 8620 - protein, 574 aa, synthetic construct
  REGION 1..574: note = derived and/or modified protein sequence (wt) from HRSV__BBA57901.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSRVLDLKNYINNQLLPMVNRQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8621 - protein, 574 aa, synthetic construct
  REGION 1..574: note = derived and/or modified protein sequence (wt) from HRSV__ASZ70099.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNNKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8622 - protein, 574 aa, synthetic construct
  REGION 1..574: note = derived and/or modified protein sequence (wt) from HRSV__ART28361.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVIVLALIAVGLLLYCKARSTPVTLSKDQLSGINNIAFSN

SEQ ID NO: 8623 - protein, 574 aa, synthetic construct
  REGION 1..574: note = derived and/or modified protein sequence (wt) from HRSV__AQX36844.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKAQSNRVFNNTITSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8624 - protein, 574 aa, synthetic construct
  REGION 1..574: note = derived and/or modified protein sequence (wt) from HRSV__ASK05520.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQHMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8625 - protein, 574 aa, synthetic construct
  REGION 1..574: note = derived and/or modified protein sequence (wt) from HRSV__ART28427.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLEFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8626 - protein, 574 aa, synthetic construct
  REGION 1..574: note = derived and/or modified protein sequence (wt) from HRSV__ART28297.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLSFIRKSDELLHNVNVGKSTTNIMITTIIIVIIVILLALIAVGLLLYCKARSTPVTLSKDQLSGINNIAFSN

SEQ ID NO: 8627 - protein, 574 aa, synthetic construct
  REGION 1..574: note = derived and/or modified protein sequence (wt) from HRSV__ART28328.1__F0
MDSPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8628 - protein, 574 aa, synthetic construct
  REGION 1..574: note = derived and/or modified protein sequence (wt) from HRSV__ARQ15966.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLYNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8629 - protein, 574 aa, synthetic construct
  REGION 1..574: note = derived and/or modified protein sequence (wt) from HRSV__ARN61507.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKGLYVKGEPIINFYDPLVFPSDEFDASISQVDEKINQSLAFLRKSDELLHNVNAGKSTTNIMITTIIIVIIVILLALIAVGLLLYCKARSTPVTLSKDQLSGINNIAFSN

SEQ ID NO: 8630 - protein, 574 aa, synthetic construct
  REGION 1..574: note = derived and/or modified protein sequence (wt) from HRSV__ARA15413.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKSALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKKTPVTLSKDQLSGINNIAFSK

SEQ ID NO: 8631 - protein, 574 aa, synthetic construct
  REGION 1..574: note = derived and/or modified protein sequence (wt) from HRSV__AGG39394.1__F0
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 8632 - protein, 574 aa, synthetic construct
  REGION 1..574: note = derived and/or modified protein sequence (wt) from HRSV__APW78845.1__F0
MELLIHRPSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNPNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8633 - protein, 574 aa, synthetic construct
  REGION 1..574: note = derived and/or modified protein sequence (wt) from HRSV__APW78867.1__F0
MELLIHRSSAIFLTLAINALYLTSSQNITEEFYQSTCSAVSRGYLSALRTGWYTSVITIELSNIKETKCNGTDTKVKLIKQELDKYRNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8634 - protein, 574 aa, synthetic construct
  REGION 1..574: note = derived and/or modified protein sequence (wt) from HRSV__APW78900.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNCTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8635 - protein, 574 aa, synthetic construct
  REGION 1..574: note = derived and/or modified protein sequence (wt) from HRSV__APW78878.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTQAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8636 - protein, 574 aa, synthetic construct
  REGION 1..574: note = derived and/or modified protein sequence (wt) from HRSV__APW78779.1__F0
MELLIYRSSAIFLTLAINALYLTSSQNITEEFYQSTCSAVSKGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8637 - protein, 574 aa, synthetic construct
  REGION 1..574: note = derived and/or modified protein sequence (wt) from HRSV__APW78702.1__F0
MELLIHRSSAIFLTLAINALYLTSSQNITEEFYQSTCSAVSRGYLSALRSGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLLLIAIGLLLYCKAKNTPVTLSKDQLSGINNIAFSK

SEQ ID NO: 8638 - protein, 574 aa, synthetic construct
  REGION 1..574: note = derived and/or modified protein sequence (wt) from HRSV__APW78713.1__F0
MELLIHRSSAIFLTLAIKALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8639 - protein, 574 aa, synthetic construct
  REGION 1..574: note = derived and/or modified protein sequence (wt) from HRSV__APW78680.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8640 - protein, 574 aa, synthetic construct
  REGION 1..574: note = derived and/or modified protein sequence (wt) from HRSV__APW78658.1__F0
MELLIHRSSAIFLTLAINALYLTSSQNITEEFYQSTCSAVSRGYWSALRTGWYTSVITIELSNIKETKCNGTDTKVKLIKQELDKYKNAVTELQLLMQNTPAVNNRARREAPQYMDYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8641 - protein, 574 aa, synthetic construct
  REGION 1..574: note = derived and/or modified protein sequence (wt) from HRSV__APW78647.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAIASGIAVSKVLHLEGEVNKIKNALLSTNKAVVSLSNGVSVLTNKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8642 - protein, 574 aa, synthetic construct
  REGION 1..574: note = derived and/or modified protein sequence (wt) from HRSV__APW78636.1__F0
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8643 - protein, 574 aa, synthetic construct
  REGION 1..574: note = derived and/or modified protein sequence (wt) from HRSV__AOS48870.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKSLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8644 - protein, 574 aa, synthetic construct
  REGION 1..574: note = derived and/or modified protein sequence (wt) from HRSV__APW78614.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLLLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8645 - protein, 574 aa, synthetic construct
  REGION 1..574: note = derived and/or modified protein sequence (wt) from HRSV__AMT78905.1__F0
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8646 - protein, 574 aa, synthetic construct
  REGION 1..574: note = derived and/or modified protein sequence (wt) from HRSV__AMT77402.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSNNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8647 - protein, 574 aa, synthetic construct
  REGION 1..574: note = derived and/or modified protein sequence (wt) from HRSV__APW29972.1__F0
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPFTLSKDQLSGINNIAFSN

SEQ ID NO: 8648 - protein, 574 aa, synthetic construct
  REGION 1..574: note = derived and/or modified protein sequence (wt) from HRSV__AOZ15479.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLASIAVGLLLYCKARSTPVTLSKDQLSGINNIAFSN

SEQ ID NO: 8649 - protein, 574 aa, synthetic construct
  REGION 1..574: note = derived and/or modified protein sequence (wt) from HRSV__AGN28484.1__F0
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8650 - protein, 574 aa, synthetic construct
  REGION 1..574: note = derived and/or modified protein sequence (wt) from HRSV__AHX57240.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNGELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLYNVNAGKSTTNIMITTIIIVIIVILLALIAIGLLLYCKARSTPVTLSKDQLSGINNIAFSN

SEQ ID NO: 8651 - protein, 574 aa, synthetic construct
  REGION 1..574: note = derived and/or modified protein sequence (wt) from HRSV__AHX57031.1__F0
MELPILKTNAITTILAAVTLCFASSQNITEEFYQSTCSAVSKGYLSALRTGWYTSVITIELSNIKENKCNGTDAKVKLIKQELDKYKNAITELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8652 - protein, 574 aa, synthetic construct
  REGION 1..574: note = derived and/or modified protein sequence (wt) from HRSV__AOS48980.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSINAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8653 - protein, 574 aa, synthetic construct
  REGION 1..574: note = derived and/or modified protein sequence (wt) from HRSV__AOS48848.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYYKAKNTPVTLSKDQLSGINNIAFSK

SEQ ID NO: 8654 - protein, 574 aa, synthetic construct
  REGION 1..574: note = derived and/or modified protein sequence (wt) from HRSV__AOS48815.1__F0
MELPILKTNAIITILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8655 - protein, 574 aa, synthetic construct
  REGION 1..574: note = derived and/or modified protein sequence (wt) from HRSV__AOS48738.1__F0
MELLIHRSSAIFLNLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8656 - protein, 574 aa, synthetic construct
  REGION 1..574: note = derived and/or modified protein sequence (wt) from HRSV__AOS49068.1__F0
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMIIAIIIVIIVVLLSLIAIGLLLYCKAKNTPVTLSKDQLSGINNIAFSK

SEQ ID NO: 8657 - protein, 574 aa, synthetic construct
  REGION 1..574: note = derived and/or modified protein sequence (wt) from HRSV__AOS48727.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLIYCKARSTPVTLSKDQLSGINNIAFSN

SEQ ID NO: 8658 - protein, 574 aa, synthetic construct
  REGION 1..574: note = derived and/or modified protein sequence (wt) from HRSV__AOS48716.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQSETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8659 - protein, 574 aa, synthetic construct
  REGION 1..574: note = derived and/or modified protein sequence (wt) from HRSV__AOS48683.1__F0
MELLIHRSSAIFLTLTINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8660 - protein, 574 aa, synthetic construct
  REGION 1..574: note = derived and/or modified protein sequence (wt) from HRSV__AOS48551.1__F0
MELPILKTNAITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8661 - protein, 574 aa, synthetic construct
  REGION 1..574: note = derived and/or modified protein sequence (wt) from HRSV__AOS48485.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALHSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSEYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8662 - protein, 574 aa, synthetic construct
  REGION 1..574: note = derived and/or modified protein sequence (wt) from HRSV__AOS48518.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFINYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8663 - protein, 574 aa, synthetic construct
  REGION 1..574: note = derived and/or modified protein sequence (wt) from HRSV__AOS48463.1__F0
MELPILKTNAITIILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8664 - protein, 574 aa, synthetic construct
  REGION 1..574: note = derived and/or modified protein sequence (wt) from HRSV__AOS48441.1__F0
MELLIHRSSAIFLTLAINTLYLTSSQNITEEFYQSTCSAVSRGYFSALRTGWYTSVITIELSNIKETKCNGTDTKVKLIKQELDKYKNAVIELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKGEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8665 - protein, 574 aa, synthetic construct
  REGION 1..574: note = derived and/or modified protein sequence (wt) from HRSV__AOS48397.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKDGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8666 - protein, 574 aa, synthetic construct
  REGION 1..574: note = derived and/or modified protein sequence (wt) from HRSV__AOS48375.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFINYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKLEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8667 - protein, 574 aa, synthetic construct
  REGION 1..574: note = derived and/or modified protein sequence (wt) from HRSV__AOS48353.1__F0
MELLIHRSSAIFLTFAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINKQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8668 - protein, 574 aa, synthetic construct
  REGION 1..574: note = derived and/or modified protein sequence (wt) from HRSV__AOS48287.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGIGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIIITTIIIVIIVILLALIAVGLLLYCKARSTPVTLSKDQLSGINNIAFSN

SEQ ID NO: 8669 - protein, 574 aa, synthetic construct
  REGION 1..574: note = derived and/or modified protein sequence (wt) from HRSV__AOS48320.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYINYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8670 - protein, 574 aa, synthetic construct
  REGION 1..574: note = derived and/or modified protein sequence (wt) from HRSV__AOS48265.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINSQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8671 - protein, 574 aa, synthetic construct
  REGION 1..574: note = derived and/or modified protein sequence (wt) from HRSV__AOS48254.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTFNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8672 - protein, 574 aa, synthetic construct
  REGION 1..574: note = derived and/or modified protein sequence (wt) from HRSV__AOS48221.1__F0
MELLIRRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIHRSDELLHNVNTGKSTTNIMITAIIIVIIVVLLSLIAIGLLLYCKAKNTPVTLSKDQLSGINNIAFSK

SEQ ID NO: 8673 - protein, 574 aa, synthetic construct
  REGION 1..574: note = derived and/or modified protein sequence (wt) from HRSV__ANZ79638.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMMTTIIIVIIVILLALIAVGLLLYCKARSTPVTLSKDQLSGINNIAFSN

SEQ ID NO: 8674 - protein, 574 aa, synthetic construct
  REGION 1..574: note = derived and/or modified protein sequence (wt) from HRSV__ALC74025.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8675 - protein, 574 aa, synthetic construct
  REGION 1..574: note = derived and/or modified protein sequence (wt) from HRSV__AJZ69825.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARNTPVTLSKDQLSGINNIAFSN

SEQ ID NO: 8676 - protein, 574 aa, synthetic construct
  REGION 1..574: note = derived and/or modified protein sequence (wt) from HRSV__AHV81286.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8677 - protein, 574 aa, synthetic construct
  REGION 1..574: note = derived and/or modified protein sequence (wt) from HRSV__AOD40516.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNANAGKSTTNIMITTIIIVIIVILLALIAVGLLLYCKARSTPVTLSKDQLSGINNIAFSN

SEQ ID NO: 8678 - protein, 574 aa, synthetic construct
  REGION 1..574: note = derived and/or modified protein sequence (wt) from HRSV__AOD40125.1__F0
MELPILKTNAITTILAAVTLCFASSQNITEEFYQSTCSAVSKGYLSALRTGWYTSVITVELSNIKENKCNGTDAKVKLIKQELDKYKNAVTELQLLMQSTPAANSRARRELPRSMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8679 - protein, 574 aa, synthetic construct
  REGION 1..574: note = derived and/or modified protein sequence (wt) from HRSV__AOD40104.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLGKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITIIIIVIIVILLALIAVGLLLYCKARSTPVTLSKDQLSGINNIAFSN

SEQ ID NO: 8680 - protein, 574 aa, synthetic construct
  REGION 1..574: note = derived and/or modified protein sequence (wt) from HRSV__AOD40082.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLGKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8681 - protein, 574 aa, synthetic construct
  REGION 1..574: note = derived and/or modified protein sequence (wt) from HRSV__AOD39908.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITIIIIVIIVILLALIAVGLLLYCKARSTPVTLSKDQLSGINNIAFSN

SEQ ID NO: 8682 - protein, 574 aa, synthetic construct
  REGION 1..574: note = derived and/or modified protein sequence (wt) from HRSV__AJF44826.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTPNNTKNTNVTLGKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITIIIIVIIVILLALIAVGLLLYCKARSTPVTLSKDQLSGINNIAFSN

SEQ ID NO: 8683 - protein, 574 aa, synthetic construct
  REGION 1..574: note = derived and/or modified protein sequence (wt) from HRSV__AJF44506.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRSMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8684 - protein, 574 aa, synthetic construct
  REGION 1..574: note = derived and/or modified protein sequence (wt) from HRSV__AJF44535.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8685 - protein, 574 aa, synthetic construct
  REGION 1..574: note = derived and/or modified protein sequence (wt) from HRSV__ANZ80463.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNSRARRELPRFMNYTLNDTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8686 - protein, 574 aa, synthetic construct
  REGION 1..574: note = derived and/or modified protein sequence (wt) from HRSV__ANZ80408.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTIKTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITAIIIVIIVVLLSLIAIGLLLYCKAKNTPVTLSKDQLSGINNIAFSK

SEQ ID NO: 8687 - protein, 574 aa, synthetic construct
  REGION 1..574: note = derived and/or modified protein sequence (wt) from HRSV__ANZ80397.1__F0
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLDGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8688 - protein, 574 aa, synthetic construct
  REGION 1..574: note = derived and/or modified protein sequence (wt) from HRSV__ANZ80386.1__F0
MELLIHRSSAIFLTLAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8689 - protein, 574 aa, synthetic construct
  REGION 1..574: note = derived and/or modified protein sequence (wt) from HRSV__ANZ80331.1__F0
MELPILKTNAIITILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQIPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8690 - protein, 574 aa, synthetic construct
  REGION 1..574: note = derived and/or modified protein sequence (wt) from HRSV__ANZ80320.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNYTKNTNVTLSKKRKRRFLGFLLGIGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8691 - protein, 574 aa, synthetic construct
  REGION 1..574: note = derived and/or modified protein sequence (wt) from HRSV__ANZ80364.1__F0
MELPIFKTNAITTILAVVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8692 - protein, 574 aa, synthetic construct
  REGION 1..574: note = derived and/or modified protein sequence (wt) from HRSV__ANZ80276.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYVNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8693 - protein, 574 aa, synthetic construct
  REGION 1..574: note = derived and/or modified protein sequence (wt) from HRSV__ANZ80221.1__F0
MELLIHRSNAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8694 - protein, 574 aa, synthetic construct
  REGION 1..574: note = derived and/or modified protein sequence (wt) from HRSV__ANZ80188.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTFNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8695 - protein, 574 aa, synthetic construct
  REGION 1..574: note = derived and/or modified protein sequence (wt) from HRSV__ANZ80144.1__F0
MELPILKTNAITTILAAVTLCFASSQNITEEFYQSTCSAVSKGYLSALRTGWYTSVITIELSNIKENKCNGTDAKVKLIKQELDKYKNAITELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMMTTIIIVIIVILLALIAVGLLLYCKARSTPVTLSKDQLSGINNIAFSN

SEQ ID NO: 8696 - protein, 574 aa, synthetic construct
  REGION 1..574: note = derived and/or modified protein sequence (wt) from HRSV__ANZ80133.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNRQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8697 - protein, 574 aa, synthetic construct
  REGION 1..574: note = derived and/or modified protein sequence (wt) from HRSV__ANZ80111.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAKSTPVTLSKDQLSGINNIAFSN

SEQ ID NO: 8698 - protein, 574 aa, synthetic construct
  REGION 1..574: note = derived and/or modified protein sequence (wt) from HRSV__ANZ80122.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTINLNISISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8699 - protein, 574 aa, synthetic construct
  REGION 1..574: note = derived and/or modified protein sequence (wt) from HRSV__ANZ80056.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFFNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8700 - protein, 574 aa, synthetic construct
  REGION 1..574: note = derived and/or modified protein sequence (wt) from HRSV__ANZ80012.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNYTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARNTPVTLSKDQLSGINNIAFSN

SEQ ID NO: 8701 - protein, 574 aa, synthetic construct
  REGION 1..574: note = derived and/or modified protein sequence (wt) from HRSV__ANZ80067.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGNLNVSIGKRRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8702 - protein, 574 aa, synthetic construct
  REGION 1..574: note = derived and/or modified protein sequence (wt) from HRSV__ANZ79979.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDISSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8703 - protein, 574 aa, synthetic construct
  REGION 1..574: note = derived and/or modified protein sequence (wt) from HRSV__ANZ79935.1__F0
MELPILKTNAIITILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAKNTPVTLSKDQLSGINNIAFSN

SEQ ID NO: 8704 - protein, 574 aa, synthetic construct
  REGION 1..574: note = derived and/or modified protein sequence (wt) from HRSV__ANZ79990.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREVPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8705 - protein, 574 aa, synthetic construct
  REGION 1..574: note = derived and/or modified protein sequence (wt) from HRSV__ANZ79902.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNNELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8706 - protein, 574 aa, synthetic construct
  REGION 1..574: note = derived and/or modified protein sequence (wt) from HRSV__ANZ79759.1__F0
MELPILKANAIATVLAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYKLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMMTTIIIVIIVILLALIAVGLLLYCKARSTPVTLSKDQLSGINNIAFSN

SEQ ID NO: 8707 - protein, 574 aa, synthetic construct
  REGION 1..574: note = derived and/or modified protein sequence (wt) from HRSV__ANZ79715.1__F0
MELPILKINAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQVVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8708 - protein, 574 aa, synthetic construct
  REGION 1..574: note = derived and/or modified protein sequence (wt) from HRSV__ANZ79671.1__F0
MELPILKINAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNINAGKSTTNIMITTIIIVIIVILLALIAVGLLLYCKARSTPVTLSKDQLSGINNIAFSN

SEQ ID NO: 8709 - protein, 574 aa, synthetic construct
  REGION 1..574: note = derived and/or modified protein sequence (wt) from HRSV__ANZ79649.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNYTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8710 - protein, 574 aa, synthetic construct
  REGION 1..574: note = derived and/or modified protein sequence (wt) from HRSV__AII22031.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAKNTPVTLSKDQLSGINNIAFSN

SEQ ID NO: 8711 - protein, 574 aa, synthetic construct
  REGION 1..574: note = derived and/or modified protein sequence (wt) from HRSV__AMT79718.1__F0
MELPILKTNAITTILAAVTLCFAFSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8712 - protein, 574 aa, synthetic construct
  REGION 1..574: note = derived and/or modified protein sequence (wt) from HRSV__AMT79586.1__F0
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAASNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8713 - protein, 574 aa, synthetic construct
  REGION 1..574: note = derived and/or modified protein sequence (wt) from HRSV__AMT79553.1__F0
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTINIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8714 - protein, 574 aa, synthetic construct
  REGION 1..574: note = derived and/or modified protein sequence (wt) from HRSV__AMT79542.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTSSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8715 - protein, 574 aa, synthetic construct
  REGION 1..574: note = derived and/or modified protein sequence (wt) from HRSV__AMT79476.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLASIAVGLLLYCKARSTPVTLSKDQLSGINNIAFSN

SEQ ID NO: 8716 - protein, 574 aa, synthetic construct
  REGION 1..574: note = derived and/or modified protein sequence (wt) from HRSV__AMT79388.1__F0
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAVASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSVIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8717 - protein, 574 aa, synthetic construct
  REGION 1..574: note = derived and/or modified protein sequence (wt) from HRSV__AMT79201.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARREIPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8718 - protein, 574 aa, synthetic construct
  REGION 1..574: note = derived and/or modified protein sequence (wt) from HRSV__AMT79190.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGFGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8719 - protein, 574 aa, synthetic construct
  REGION 1..574: note = derived and/or modified protein sequence (wt) from HRSV__AMT79157.1__F0
MELLIRRSSAIFLTFAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8720 - protein, 574 aa, synthetic construct
  REGION 1..574: note = derived and/or modified protein sequence (wt) from HRSV__AMT79124.1__F0
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8721 - protein, 574 aa, synthetic construct
  REGION 1..574: note = derived and/or modified protein sequence (wt) from HRSV__AMT79091.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCHISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8722 - protein, 574 aa, synthetic construct
  REGION 1..574: note = derived and/or modified protein sequence (wt) from HRSV__AMT79047.1__F0
MELPILKTNAITTILAAVTLCFTSSQNITEEFYQSTCSAVSKGYLSALRTGWYTSVITIELSNIKENKCNGTDTKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8723 - protein, 574 aa, synthetic construct
  REGION 1..574: note = derived and/or modified protein sequence (wt) from HRSV__AMT79014.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNANAGKSTTNIMITTIIIVIIVILLALIAVGLLLYCKARSTPVTLSKDQLSGINNIAFSN

SEQ ID NO: 8724 - protein, 574 aa, synthetic construct
  REGION 1..574: note = derived and/or modified protein sequence (wt) from HRSV__AMT79003.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKARNTPVTLSKDQLSGINNIAFSK

SEQ ID NO: 8725 - protein, 574 aa, synthetic construct
  REGION 1..574: note = derived and/or modified protein sequence (wt) from HRSV__AMT78872.1__F0
MELPILKTNAITTILTAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8726 - protein, 574 aa, synthetic construct
  REGION 1..574: note = derived and/or modified protein sequence (wt) from HRSV__AMT78832.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINYYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8727 - protein, 574 aa, synthetic construct
  REGION 1..574: note = derived and/or modified protein sequence (wt) from HRSV__AMT78689.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIIIIVILLALIAVGLLLYCKARSTPVTLSKDQLSGINNIAFSN

SEQ ID NO: 8728 - protein, 574 aa, synthetic construct
  REGION 1..574: note = derived and/or modified protein sequence (wt) from HRSV__AMT78645.1__F0
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSIYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8729 - protein, 574 aa, synthetic construct
  REGION 1..574: note = derived and/or modified protein sequence (wt) from HRSV__AMT78513.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRSRRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8730 - protein, 574 aa, synthetic construct
  REGION 1..574: note = derived and/or modified protein sequence (wt) from HRSV__AMT78480.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSILTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8731 - protein, 574 aa, synthetic construct
  REGION 1..574: note = derived and/or modified protein sequence (wt) from HRSV__AMT78447.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSNNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGKPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8732 - protein, 574 aa, synthetic construct
  REGION 1..574: note = derived and/or modified protein sequence (wt) from HRSV__AMT78392.1__F0
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPVANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKTKNTPVTLSKDQLSGINNIAFSK

SEQ ID NO: 8733 - protein, 574 aa, synthetic construct
  REGION 1..574: note = derived and/or modified protein sequence (wt) from HRSV__AMT78194.1__F0
MELLIHRSSAIFLNFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8734 - protein, 574 aa, synthetic construct
  REGION 1..574: note = derived and/or modified protein sequence (wt) from HRSV__AMT78084.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFTNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8735 - protein, 574 aa, synthetic construct
  REGION 1..574: note = derived and/or modified protein sequence (wt) from HRSV__AMT78051.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTDVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8736 - protein, 574 aa, synthetic construct
  REGION 1..574: note = derived and/or modified protein sequence (wt) from HRSV__AMT77963.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEDVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8737 - protein, 574 aa, synthetic construct
  REGION 1..574: note = derived and/or modified protein sequence (wt) from HRSV__AMT77908.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8738 - protein, 574 aa, synthetic construct
  REGION 1..574: note = derived and/or modified protein sequence (wt) from HRSV__AMT77776.1__F0
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCRAKNTPVTLSKDQLSGINNIAFSK

SEQ ID NO: 8739 - protein, 574 aa, synthetic construct
  REGION 1..574: note = derived and/or modified protein sequence (wt) from HRSV__AMT77710.1__F0
MELLIRRSSAIFLTLAINTLYLTSSQNITEEFYQSTCSAVSRGYFSALRTGWYTSVITIELSNIKETRCNGTDTKVKLIKQELDKYKNAVTELQLLMQNTPAANNRARREAPQYMNYTINTTKNPNASISKRRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8740 - protein, 574 aa, synthetic construct
  REGION 1..574: note = derived and/or modified protein sequence (wt) from HRSV__AMT77501.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLNKDQLSGINNIAFSN

SEQ ID NO: 8741 - protein, 574 aa, synthetic construct
  REGION 1..574: note = derived and/or modified protein sequence (wt) from HRSV__AMT77424.1__F0
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNKKINQSLAFIRRSDELLHNVNTGKSTTNIMITAIIIVIIVVLLSLIAIGLLLYCKAKNTPVTLSKDQLSGINNIAFSK

SEQ ID NO: 8742 - protein, 574 aa, synthetic construct
  REGION 1..574: note = derived and/or modified protein sequence (wt) from HRSV__AMN91385.1__F0
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8743 - protein, 574 aa, synthetic construct
  REGION 1..574: note = derived and/or modified protein sequence (wt) from HRSV__AMN91264.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINATKNLNVSISKKRKRRFLGFLLGVGSAIASGIAVSKVLHLEGEVNKIKNALQSTNKAVVSLSNGVSVLTSKVLDLKNYINSQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8744 - protein, 574 aa, synthetic construct
  REGION 1..574: note = derived and/or modified protein sequence (wt) from HRSV__AMN91242.1__F0
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8745 - protein, 574 aa, synthetic construct
  REGION 1..574: note = derived and/or modified protein sequence (wt) from HRSV__AHX57504.1__F0
MELPILKTNAITTILAAVTLCFASNQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8746 - protein, 574 aa, synthetic construct
  REGION 1..574: note = derived and/or modified protein sequence (wt) from HRSV__CUS01881.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRITNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8747 - protein, 574 aa, synthetic construct
  REGION 1..574: note = derived and/or modified protein sequence (wt) from HRSV__CUS01870.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTNIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8748 - protein, 574 aa, synthetic construct
  REGION 1..574: note = derived and/or modified protein sequence (wt) from HRSV__AMA67350.1__F0
MELLIHRSSAIFLTLAINALYFTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8749 - protein, 574 aa, synthetic construct
  REGION 1..574: note = derived and/or modified protein sequence (wt) from HRSV__AMA67251.1__F0
MELLIHRSSAIFLTLAINALCLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8750 - protein, 574 aa, synthetic construct
  REGION 1..574: note = derived and/or modified protein sequence (wt) from HRSV__AMA67262.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRVMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8751 - protein, 574 aa, synthetic construct
  REGION 1..574: note = derived and/or modified protein sequence (wt) from HRSV__AMA67229.1__F0
MELPILKANAITTILIAVTFCFASSQNITEEFYQSTCSAVSKGYFSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8752 - protein, 574 aa, synthetic construct
  REGION 1..574: note = derived and/or modified protein sequence (wt) from HRSV__AMA67196.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAEKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8753 - protein, 574 aa, synthetic construct
  REGION 1..574: note = derived and/or modified protein sequence (wt) from HRSV__AMA67130.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELSRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8754 - protein, 574 aa, synthetic construct
  REGION 1..574: note = derived and/or modified protein sequence (wt) from HRSV__AMA67185.1__F0
MELPILKTNAITTILAAVTLCLASSQNITEEFYQSTCSAVSKGYLSALRTGWYTSVITIELSNIKENKCNGTDAKVKLIKQELDKYKNAVTELQLLMQNTPAANNRARRELPRFMNYTLNNTKNTNATLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8755 - protein, 574 aa, synthetic construct
  REGION 1..574: note = derived and/or modified protein sequence (wt) from HRSV__AMA67163.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNRGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8756 - protein, 574 aa, synthetic construct
  REGION 1..574: note = derived and/or modified protein sequence (wt) from HRSV__AMA67086.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGIGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8757 - protein, 574 aa, synthetic construct
  REGION 1..574: note = derived and/or modified protein sequence (wt) from HRSV__AMA67075.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIVKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8758 - protein, 574 aa, synthetic construct
  REGION 1..574: note = derived and/or modified protein sequence (wt) from HRSV__AMA66998.1__F0
MELPILKTNAITTILAAATLCFTSSQNITEEFYQSTCSAVSKGYLSALRTGWYTSVITIELSNIKENKCNGTDAKVKLIKQELDKYKNAVTELQLLMQSTPAANNRARRELPRFMNYTLDNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8759 - protein, 574 aa, synthetic construct
  REGION 1..574: note = derived and/or modified protein sequence (wt) from HRSV__AMA66987.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPKFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8760 - protein, 574 aa, synthetic construct
  REGION 1..574: note = derived and/or modified protein sequence (wt) from HRSV__AMA66976.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAIGLLLYCKARSTPVTLSKDQLSGINNIAFSN

SEQ ID NO: 8761 - protein, 574 aa, synthetic construct
  REGION 1..574: note = derived and/or modified protein sequence (wt) from HRSV__AMA66965.1__F0
MELLIHKSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLMAIGLLLYCKAKNTPVTLSKDQLSGINNIAFSK

SEQ ID NO: 8762 - protein, 574 aa, synthetic construct
  REGION 1..574: note = derived and/or modified protein sequence (wt) from HRSV__AMA66921.1__F0
MELPILKTNAITTILAAATLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMSSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8763 - protein, 574 aa, synthetic construct
  REGION 1..574: note = derived and/or modified protein sequence (wt) from HRSV__AMA66844.1__F0
MELLIYRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYTNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8764 - protein, 574 aa, synthetic construct
  REGION 1..574: note = derived and/or modified protein sequence (wt) from HRSV__AMA66833.1__F0
MELPILKTNAITTILAAVTLCFASSQNITEEFYQATCSAVSKGYLSALRTGWYTSVITIELSNIKENKCNGTDAKVKLIKQELDKYKNAVTELQLLMQSTPAANNRARRELPKFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8765 - protein, 574 aa, synthetic construct
  REGION 1..574: note = derived and/or modified protein sequence (wt) from HRSV__AMA66624.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQKTPAVNNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCNNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8766 - protein, 574 aa, synthetic construct
  REGION 1..574: note = derived and/or modified protein sequence (wt) from HRSV__AMA66613.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYTNYTINTTKNLNVSISKKRKRRFLGFLLGVGSAIASGIAVSKVLHLEGEVNKIKSALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8767 - protein, 574 aa, synthetic construct
  REGION 1..574: note = derived and/or modified protein sequence (wt) from HRSV__AMA66591.1__F0
MKLLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8768 - protein, 574 aa, synthetic construct
  REGION 1..574: note = derived and/or modified protein sequence (wt) from HRSV__AMA66569.1__F0
MELLIHRSSAIFLTIAINALYLTSSQNITEEFYQSTCSAVSRGYFSALRTGWYTSVITIELSNIKETKCNGTDTKVKLIKQELDKYKNAVTELQLLMQNTPAANNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8769 - protein, 574 aa, synthetic construct
  REGION 1..574: note = derived and/or modified protein sequence (wt) from HRSV__AMA66547.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPKFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8770 - protein, 574 aa, synthetic construct
  REGION 1..574: note = derived and/or modified protein sequence (wt) from HRSV__AMA66503.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8771 - protein, 574 aa, synthetic construct
  REGION 1..574: note = derived and/or modified protein sequence (wt) from HRSV__AMA66492.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIMSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVSLSKDQLSGINNIAFSN

SEQ ID NO: 8772 - protein, 574 aa, synthetic construct
  REGION 1..574: note = derived and/or modified protein sequence (wt) from HRSV__AMA66481.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTFNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSNELLHNVNAGKSTTNIMITTIIIVIIVILLSLIAVGLLLYCKARSTPVTLSKDQLSGINNIAFSN

SEQ ID NO: 8773 - protein, 574 aa, synthetic construct
  REGION 1..574: note = derived and/or modified protein sequence (wt) from HRSV__AMA66448.1__F0
MELLIHRSSAIFLTLAINALYLTSSQNITEEFYQSTCSAVSRGYFSALRTGWYTSVITIELSNIKETKCNGTDTKVKLINQELDKYKNAVTELQLLMQNTPAANNRARREAPRYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8774 - protein, 574 aa, synthetic construct
  REGION 1..574: note = derived and/or modified protein sequence (wt) from HRSV__AMA66415.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8775 - protein, 574 aa, synthetic construct
  REGION 1..574: note = derived and/or modified protein sequence (wt) from HRSV__AMA66393.1__F0
MELLIHKSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLMAIGLLLYCKAKNTPVTLSKDQLSGINNIAFSK

SEQ ID NO: 8776 - protein, 574 aa, synthetic construct
  REGION 1..574: note = derived and/or modified protein sequence (wt) from HRSV__AMA66360.1__F0
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIVVGLLLYCKARSTPVTLSKDQLSGINNIAFSN

SEQ ID NO: 8777 - protein, 574 aa, synthetic construct
  REGION 1..574: note = derived and/or modified protein sequence (wt) from HRSV__AGG39553.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTVNTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8778 - protein, 574 aa, synthetic construct
  REGION 1..574: note = derived and/or modified protein sequence (wt) from HRSV__AGG39469.1__F0
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 8779 - protein, 574 aa, synthetic construct
  REGION 1..574: note = derived and/or modified protein sequence (wt) from HRSV__AJZ70144.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTSSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8780 - protein, 574 aa, synthetic construct
  REGION 1..574: note = derived and/or modified protein sequence (wt) from HRSV__AJZ70166.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8781 - protein, 574 aa, synthetic construct
  REGION 1..574: note = derived and/or modified protein sequence (wt) from HRSV__AJZ70155.1__F0
MELPILKTNAITTILAAVTICFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8782 - protein, 574 aa, synthetic construct
  REGION 1..574: note = derived and/or modified protein sequence (wt) from HRSV__AJZ70133.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRTRRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8783 - protein, 574 aa, synthetic construct
  REGION 1..574: note = derived and/or modified protein sequence (wt) from HRSV__AJZ70067.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPITLSKDQLSGINNIAFSN

SEQ ID NO: 8784 - protein, 574 aa, synthetic construct
  REGION 1..574: note = derived and/or modified protein sequence (wt) from HRSV__AJZ69946.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8785 - protein, 574 aa, synthetic construct
  REGION 1..574: note = derived and/or modified protein sequence (wt) from HRSV__AJZ69913.1__F0
MELPILNTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8786 - protein, 574 aa, synthetic construct
  REGION 1..574: note = derived and/or modified protein sequence (wt) from HRSV__AJZ69880.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTPNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8787 - protein, 574 aa, synthetic construct
  REGION 1..574: note = derived and/or modified protein sequence (wt) from HRSV__AJZ69847.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8788 - protein, 574 aa, synthetic construct
  REGION 1..574: note = derived and/or modified protein sequence (wt) from HRSV__AJZ69869.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8789 - protein, 574 aa, synthetic construct
  REGION 1..574: note = derived and/or modified protein sequence (wt) from HRSV__AJO16077.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINITKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8790 - protein, 574 aa, synthetic construct
  REGION 1..574: note = derived and/or modified protein sequence (wt) from HRSV__AJO16055.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKHEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8791 - protein, 574 aa, synthetic construct
  REGION 1..574: note = derived and/or modified protein sequence (wt) from HRSV__AKE31881.1__F0
MELLIHRSNAIFLTLAINALYLTSSQNITEEFYQSTCSAVSRGYFSALRTGWYTSVITIELSNIKETKCNGTDTKVKLMKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8792 - protein, 574 aa, synthetic construct
  REGION 1..574: note = derived and/or modified protein sequence (wt) from HRSV__AKE31882.1__F0
MELLVHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8793 - protein, 574 aa, synthetic construct
  REGION 1..574: note = derived and/or modified protein sequence (wt) from HRSV__AJF44835.1__F0
MDLPILKTNAITTIFAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNNKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8794 - protein, 574 aa, synthetic construct
  REGION 1..574: note = derived and/or modified protein sequence (wt) from HRSV__AJF44790.1__F0
MELSILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8795 - protein, 574 aa, synthetic construct
  REGION 1..574: note = derived and/or modified protein sequence (wt) from HRSV__AJF44737.1__F0
MELPILKTNVITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKYTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8796 - protein, 574 aa, synthetic construct
  REGION 1..574: note = derived and/or modified protein sequence (wt) from HRSV__AJF44716.1__F0
MELLIHRSSAIFLTLAINALYLASSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLVAIGLLLYCKAKNTPVTLSKDQLSGINNIAFSK

SEQ ID NO: 8797 - protein, 574 aa, synthetic construct
  REGION 1..574: note = derived and/or modified protein sequence (wt) from HRSV__AJF44725.1__F0
MELPILKTNVITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKYTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8798 - protein, 574 aa, synthetic construct
  REGION 1..574: note = derived and/or modified protein sequence (wt) from HRSV__AJF44643.1__F0
MELLIHRSSAIFLTLAINALYLASSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8799 - protein, 574 aa, synthetic construct
  REGION 1..574: note = derived and/or modified protein sequence (wt) from HRSV__AJF44628.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8800 - protein, 574 aa, synthetic construct
  REGION 1..574: note = derived and/or modified protein sequence (wt) from HRSV__AJF44624.1__F0
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAINNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNNRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8801 - protein, 574 aa, synthetic construct
  REGION 1..574: note = derived and/or modified protein sequence (wt) from HRSV__AJF44613.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNSNVSTIKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8802 - protein, 574 aa, synthetic construct
  REGION 1..574: note = derived and/or modified protein sequence (wt) from HRSV__AJF44566.1__F0
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAINNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8803 - protein, 574 aa, synthetic construct
  REGION 1..574: note = derived and/or modified protein sequence (wt) from HRSV__AJF44555.1__F0
MELLIHRSSAIFLTLAINALYLTSSQNITEEFYQSTCSAVSRGYFSALRTGWYTSVITIELSNIQETNCNGTDTKVKLIKQELDKYKNAVTELQLLMQNTPAINNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8804 - protein, 574 aa, synthetic construct
  REGION 1..574: note = derived and/or modified protein sequence (wt) from HRSV__AJF44526.1__F0
MELLIHRSSAIFLTLAINALYLTSSQNITEEFYQSTCSAVSRGYFSALRTGWYTSVITIELSNIKETKCNGTDTKVRLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8805 - protein, 574 aa, synthetic construct
  REGION 1..574: note = derived and/or modified protein sequence (wt) from HRSV__AJF44517.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8806 - protein, 574 aa, synthetic construct
  REGION 1..574: note = derived and/or modified protein sequence (wt) from HRSV__AHB33455.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKTTPVTLSKDQLSGINNIAFSK

SEQ ID NO: 8807 - protein, 574 aa, synthetic construct
  REGION 1..574: note = derived and/or modified protein sequence (wt) from HRSV__AKA45882.1__F0
MELPILKTNAITTILTAVTLCFASSQNITEEFYQSTCSAVSKGYLSALRTGWYTSVITIELSNIKENKCNGTDAKVKLIKQELDKYKNAVTELQLLMQSTPAANNRARRELSRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8808 - protein, 574 aa, synthetic construct
  REGION 1..574: note = derived and/or modified protein sequence (wt) from HRSV__AKA45849.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8809 - protein, 574 aa, synthetic construct
  REGION 1..574: note = derived and/or modified protein sequence (wt) from HRSV__AHA83913.1__F0
MELLIHRSSAIFLTLAINALYLTSSQNITEEFYQSTCSAVSRGYISALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8810 - protein, 574 aa, synthetic construct
  REGION 1..574: note = derived and/or modified protein sequence (wt) from HRSV__AGN28715.1__F0
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8811 - protein, 574 aa, synthetic construct
  REGION 1..574: note = derived and/or modified protein sequence (wt) from HRSV__AHA83902.1__F0
MELLIHRSSAIFLTLAINALYLTSSQNITEEFYQSTCSAVSRGYISALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLMFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8812 - protein, 574 aa, synthetic construct
  REGION 1..574: note = derived and/or modified protein sequence (wt) from HRSV__AHA83837.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8813 - protein, 574 aa, synthetic construct
  REGION 1..574: note = derived and/or modified protein sequence (wt) from HRSV__AHA83826.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSNELLHNVNVGKSTTNIMITTIIIVIIVILLLLIAVGLFLYCKARSTPVTLSKDQLSGINNIAFSN

SEQ ID NO: 8814 - protein, 574 aa, synthetic construct
  REGION 1..574: note = derived and/or modified protein sequence (wt) from HRSV__AHA83705.1__F0
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCNAKNTPVTLSKDQLSGINNIAFSK

SEQ ID NO: 8815 - protein, 574 aa, synthetic construct
  REGION 1..574: note = derived and/or modified protein sequence (wt) from HRSV__AHA83630.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCRARSTPVTLSKDQLSGINNIAFSN

SEQ ID NO: 8816 - protein, 574 aa, synthetic construct
  REGION 1..574: note = derived and/or modified protein sequence (wt) from HRSV__AGG39505.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNTKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8817 - protein, 574 aa, synthetic construct
  REGION 1..574: note = derived and/or modified protein sequence (wt) from HRSV__AIY70242.1__F0
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAVKSTTNIMITTIIIVIIVILLSLIVVGLLLYCKARSTPVTLSKDQLSGINNIAFSS

SEQ ID NO: 8818 - protein, 574 aa, synthetic construct
  REGION 1..574: note = derived and/or modified protein sequence (wt) from HRSV__AIY70198.1__F0
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTENTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVSLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAVKSTTNIMITTIIIVIIVILLSLIVVGLLLYCKARSTPVTLSKDQLSGINNIAFSS

SEQ ID NO: 8819 - protein, 574 aa, synthetic construct
  REGION 1..574: note = derived and/or modified protein sequence (wt) from HRSV__AII30203.1__F0
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPKFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRRQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8820 - protein, 574 aa, synthetic construct
  REGION 1..574: note = derived and/or modified protein sequence (wt) from HRSV__AHY21441.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVSLSKDQLSGINNIAFSN

SEQ ID NO: 8821 - protein, 574 aa, synthetic construct
  REGION 1..574: note = derived and/or modified protein sequence (wt) from HRSV__AHY21463.1__F0
MELPILKTNAITTIFAAVTLCFASSQNITEEFYQSTCSAVSKGYLSALRTGWYTSVITVELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8822 - protein, 574 aa, synthetic construct
  REGION 1..574: note = derived and/or modified protein sequence (wt) from HRSV__AHY21397.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYTNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8823 - protein, 574 aa, synthetic construct
  REGION 1..574: note = derived and/or modified protein sequence (wt) from HRSV__AHY21320.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKEVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8824 - protein, 574 aa, synthetic construct
  REGION 1..574: note = derived and/or modified protein sequence (wt) from HRSV__AHY21298.1__F0
MELMIHKSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITTIIIVIIVVLLSLIAIGLLLYCKAKNTPVTLSKDQLSGINNIAFSK

SEQ ID NO: 8825 - protein, 574 aa, synthetic construct
  REGION 1..574: note = derived and/or modified protein sequence (wt) from HRSV__AHY21287.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8826 - protein, 574 aa, synthetic construct
  REGION 1..574: note = derived and/or modified protein sequence (wt) from HRSV__AHY21276.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNSRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8827 - protein, 574 aa, synthetic construct
  REGION 1..574: note = derived and/or modified protein sequence (wt) from HRSV__AHY21254.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLSSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8828 - protein, 574 aa, synthetic construct
  REGION 1..574: note = derived and/or modified protein sequence (wt) from HRSV__AHY21199.1__F0
MELLIHRSSAIFLTIAINALYLTSSQNITEEFYQSTCSAVSRGYFSALRTGWYTSVITIELSNIKETKCNGTDTKVKLIKQELDKYKNAVTELQLLMQNTPATNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8829 - protein, 574 aa, synthetic construct
  REGION 1..574: note = derived and/or modified protein sequence (wt) from HRSV__AHY21176.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8830 - protein, 574 aa, synthetic construct
  REGION 1..574: note = derived and/or modified protein sequence (wt) from HRSV__AHX57537.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSSPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8831 - protein, 574 aa, synthetic construct
  REGION 1..574: note = derived and/or modified protein sequence (wt) from HRSV__AHX57471.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSSPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8832 - protein, 574 aa, synthetic construct
  REGION 1..574: note = derived and/or modified protein sequence (wt) from HRSV__AHX57427.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVKAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8833 - protein, 574 aa, synthetic construct
  REGION 1..574: note = derived and/or modified protein sequence (wt) from HRSV__AHX57042.1__F0
MELLIHRSSVIFLTLAINALYLTSSQNITEEFYQSTCSAVSRGYFSALRTGWYTSVITIELSNIKETKCNGTDTKVKLIKQELDKYKNAVTELQLLMQNIPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8834 - protein, 574 aa, synthetic construct
  REGION 1..574: note = derived and/or modified protein sequence (wt) from HRSV__AIZ95981.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYIVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8835 - protein, 574 aa, synthetic construct
  REGION 1..574: note = derived and/or modified protein sequence (wt) from HRSV__AIZ95893.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNVMITTIIIVIIVILLSLIAVGLLLYCKARSTPVTLSKDQLSGINNIAFSN

SEQ ID NO: 8836 - protein, 574 aa, synthetic construct
  REGION 1..574: note = derived and/or modified protein sequence (wt) from HRSV__AIZ95871.1__F0
MELLIHKSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAIVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8837 - protein, 574 aa, synthetic construct
  REGION 1..574: note = derived and/or modified protein sequence (wt) from HRSV__AIZ95816.1__F0
MELPILKTNAITIILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNSTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8838 - protein, 574 aa, synthetic construct
  REGION 1..574: note = derived and/or modified protein sequence (wt) from HRSV__AIZ95772.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSTGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8839 - protein, 574 aa, synthetic construct
  REGION 1..574: note = derived and/or modified protein sequence (wt) from HRSV__AIZ95684.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQISGINNIAFSK

SEQ ID NO: 8840 - protein, 574 aa, synthetic construct
  REGION 1..574: note = derived and/or modified protein sequence (wt) from HRSV__AIZ95629.1__F0
MELLIHRSSAIFLTLAINALYFTSGQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSTSKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8841 - protein, 574 aa, synthetic construct
  REGION 1..574: note = derived and/or modified protein sequence (wt) from HRSV__AIZ95673.1__F0
MESLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8842 - protein, 574 aa, synthetic construct
  REGION 1..574: note = derived and/or modified protein sequence (wt) from HRSV__AIZ95596.1__F0
MELPILKTNAITTILAAATLCFASSQNITEEFYQSTCSAVSKGYLSALRTGWYTSVITIELSNIKENKCNGTDVKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8843 - protein, 574 aa, synthetic construct
  REGION 1..574: note = derived and/or modified protein sequence (wt) from HRSV__AIZ95585.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNSTKNTNVTLSKKRKRRFLGFLLGVGSAIASGIAVSKVLHLEGEVDKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8844 - protein, 574 aa, synthetic construct
  REGION 1..574: note = derived and/or modified protein sequence (wt) from HRSV__AIZ95552.1__F0
MELPILKTNAITTILAAVTLCLASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8845 - protein, 574 aa, synthetic construct
  REGION 1..574: note = derived and/or modified protein sequence (wt) from HRSV__AHX57570.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLKNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8846 - protein, 574 aa, synthetic construct
  REGION 1..574: note = derived and/or modified protein sequence (wt) from HRSV__AHX57152.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKYTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8847 - protein, 574 aa, synthetic construct
  REGION 1..574: note = derived and/or modified protein sequence (wt) from HRSV__AHX57064.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNGELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLYNVNAGKSTTNIMITTIIIVIIVILLALIAVGLLLYCKARSTPVTLSKDQLSGINNIAFSN

SEQ ID NO: 8848 - protein, 574 aa, synthetic construct
  REGION 1..574: note = derived and/or modified protein sequence (wt) from HRSV__AHX57020.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVILSKDQLSGINNIAFSN

SEQ ID NO: 8849 - protein, 574 aa, synthetic construct
  REGION 1..574: note = derived and/or modified protein sequence (wt) from HRSV__AHX57009.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVILSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8850 - protein, 574 aa, synthetic construct
  REGION 1..574: note = derived and/or modified protein sequence (wt) from HRSV__AHX56987.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTIKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNINTGKSTTNIMITVIIIVIIVVLLSLIAIGLLLYCKAKNTPVTLSKDQLSGINNIAFSK

SEQ ID NO: 8851 - protein, 574 aa, synthetic construct
  REGION 1..574: note = derived and/or modified protein sequence (wt) from HRSV__AHV82100.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8852 - protein, 574 aa, synthetic construct
  REGION 1..574: note = derived and/or modified protein sequence (wt) from HRSV__AHV82001.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNTKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8853 - protein, 574 aa, synthetic construct
  REGION 1..574: note = derived and/or modified protein sequence (wt) from HRSV__AHV81891.1__F0
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8854 - protein, 574 aa, synthetic construct
  REGION 1..574: note = derived and/or modified protein sequence (wt) from HRSV__AHV81880.1__F0
MDLPILKTNAITTILAAVTLCFTSSQNITEEFYQSTCSAVSKGYLSALRTGWYTSVITIELSNIKENKCNGTDAKVKLIKQELDKYKNAVTELQLLMQSTPASNNRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8855 - protein, 574 aa, synthetic construct
  REGION 1..574: note = derived and/or modified protein sequence (wt) from HRSV__AHV81836.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNCTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8856 - protein, 574 aa, synthetic construct
  REGION 1..574: note = derived and/or modified protein sequence (wt) from HRSV__AHV81682.1__F0
MELPVLKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8857 - protein, 574 aa, synthetic construct
  REGION 1..574: note = derived and/or modified protein sequence (wt) from HRSV__AHV81649.1__F0
MELPIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8858 - protein, 574 aa, synthetic construct
  REGION 1..574: note = derived and/or modified protein sequence (wt) from HRSV__AHV81484.1__F0
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8859 - protein, 574 aa, synthetic construct
  REGION 1..574: note = derived and/or modified protein sequence (wt) from HRSV__AHV81462.1__F0
MELPILKTNAITTILAAVTLCFASSQNITEEFYQSTCSAVSKGYLSALRTGWYTSVITIELSNIKENKCNGTDAKVKLIKQELDRYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8860 - protein, 574 aa, synthetic construct
  REGION 1..574: note = derived and/or modified protein sequence (wt) from HRSV__AHV81385.1__F0
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8861 - protein, 574 aa, synthetic construct
  REGION 1..574: note = derived and/or modified protein sequence (wt) from HRSV__AHV81363.1__F0
MELPILKTNAITTVLAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8862 - protein, 574 aa, synthetic construct
  REGION 1..574: note = derived and/or modified protein sequence (wt) from HRSV__AHV81330.1__F0
MELPILKTNAITTILAAVTLCFASSQNITEEFYQSTCSAVSKGFLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8863 - protein, 574 aa, synthetic construct
  REGION 1..574: note = derived and/or modified protein sequence (wt) from HRSV__AHV81253.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTNNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8864 - protein, 574 aa, synthetic construct
  REGION 1..574: note = derived and/or modified protein sequence (wt) from HRSV__AHV81154.1__F0
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8865 - protein, 574 aa, synthetic construct
  REGION 1..574: note = derived and/or modified protein sequence (wt) from HRSV__AHV81122.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTNNTNVTLSKKRKRRFLGFLLGVGSAIASGIAVSKVLHLEGEVKKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8866 - protein, 574 aa, synthetic construct
  REGION 1..574: note = derived and/or modified protein sequence (wt) from HRSV__AHV81089.1__F0
MGLLIHGSSAVFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8867 - protein, 574 aa, synthetic construct
  REGION 1..574: note = derived and/or modified protein sequence (wt) from HRSV__AHV81012.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNNTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8868 - protein, 574 aa, synthetic construct
  REGION 1..574: note = derived and/or modified protein sequence (wt) from HRSV__AHV80957.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNTDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8869 - protein, 574 aa, synthetic construct
  REGION 1..574: note = derived and/or modified protein sequence (wt) from HRSV__AHV80880.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYILNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8870 - protein, 574 aa, synthetic construct
  REGION 1..574: note = derived and/or modified protein sequence (wt) from HRSV__AHV80869.1__F0
MELPILKTNAITTILAAVTLCLASSQNITEEFYQSTCSAVSKGYLSALRTGWYTSVITIELSNIKENKCNGTDAKVKLIKQELDKYKNAVTELQLLMQSTPAANSRARRELPRFRNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8871 - protein, 574 aa, synthetic construct
  REGION 1..574: note = derived and/or modified protein sequence (wt) from HRSV__AHV80836.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCATNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8872 - protein, 574 aa, synthetic construct
  REGION 1..574: note = derived and/or modified protein sequence (wt) from HRSV__AHV80803.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKDALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8873 - protein, 574 aa, synthetic construct
  REGION 1..574: note = derived and/or modified protein sequence (wt) from HRSV__AGG39559.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQQLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8874 - protein, 574 aa, synthetic construct
  REGION 1..574: note = derived and/or modified protein sequence (wt) from HRSV__AGG39562.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPSANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8875 - protein, 574 aa, synthetic construct
  REGION 1..574: note = derived and/or modified protein sequence (wt) from HRSV__AGG39556.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8876 - protein, 574 aa, synthetic construct
  REGION 1..574: note = derived and/or modified protein sequence (wt) from HRSV__AGG39550.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRIFNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8877 - protein, 574 aa, synthetic construct
  REGION 1..574: note = derived and/or modified protein sequence (wt) from HRSV__AGG39547.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPILNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8878 - protein, 574 aa, synthetic construct
  REGION 1..574: note = derived and/or modified protein sequence (wt) from HRSV__AGG39544.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQILPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8879 - protein, 574 aa, synthetic construct
  REGION 1..574: note = derived and/or modified protein sequence (wt) from HRSV__AGG39541.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRIFNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8880 - protein, 574 aa, synthetic construct
  REGION 1..574: note = derived and/or modified protein sequence (wt) from HRSV__AGG39529.1__F0
MELLIHRSNAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8881 - protein, 574 aa, synthetic construct
  REGION 1..574: note = derived and/or modified protein sequence (wt) from HRSV__AGG39526.1__F0
MELLIHRSSAIFLTLAINALYLTSSQNITEEFYQSTCSAVSRGYFSALRTGWYTSVITIELSNIKETKCNGTDTKVKLIKQELNKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8882 - protein, 574 aa, synthetic construct
  REGION 1..574: note = derived and/or modified protein sequence (wt) from HRSV__AGG39523.1__F0
MELLIHRSIAIFLTLAINALYLTSSQNITEEFYQSTCSAVSRGYFSALRTGWYTSVITIELSNITETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNVGKSTTNIMITAIIIVIIVVLLSLIAIGLLLYCKAKNTPVTLSKDQLSGINNIAFSK

SEQ ID NO: 8883 - protein, 574 aa, synthetic construct
  REGION 1..574: note = derived and/or modified protein sequence (wt) from HRSV__AGG39514.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPVANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNTKEGSNICLTRTDRGWYCDNAGSVSFFPQADTCKVQSNRVFCDTMYSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8884 - protein, 574 aa, synthetic construct
  REGION 1..574: note = derived and/or modified protein sequence (wt) from HRSV__AGG39502.1__F0
MELLVHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTNNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8885 - protein, 574 aa, synthetic construct
  REGION 1..574: note = derived and/or modified protein sequence (wt) from HRSV__AGG39499.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNIPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8886 - protein, 574 aa, synthetic construct
  REGION 1..574: note = derived and/or modified protein sequence (wt) from HRSV__AGG39496.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGISVLTSKVLDLKNYINNQLLPIVNQQSCRITNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8887 - protein, 574 aa, synthetic construct
  REGION 1..574: note = derived and/or modified protein sequence (wt) from HRSV__AGG39493.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQQLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAKNTPVTLSKDQLSGINNIAFSK

SEQ ID NO: 8888 - protein, 574 aa, synthetic construct
  REGION 1..574: note = derived and/or modified protein sequence (wt) from HRSV__AGG39484.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRITNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8889 - protein, 574 aa, synthetic construct
  REGION 1..574: note = derived and/or modified protein sequence (wt) from HRSV__AGG39490.1__F0
MELLIHRSSAIFLTLAINALYFTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8890 - protein, 574 aa, synthetic construct
  REGION 1..574: note = derived and/or modified protein sequence (wt) from HRSV__AGG39487.1__F0
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGISVLTSKVLDLKNYINNRLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 8891 - protein, 574 aa, synthetic construct
  REGION 1..574: note = derived and/or modified protein sequence (wt) from HRSV__AGG39475.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8892 - protein, 574 aa, synthetic construct
  REGION 1..574: note = derived and/or modified protein sequence (wt) from HRSV__AGG39466.1__F0
MELLILKANVIATILTAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8893 - protein, 574 aa, synthetic construct
  REGION 1..574: note = derived and/or modified protein sequence (wt) from HRSV__AGG39463.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNNELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8894 - protein, 574 aa, synthetic construct
  REGION 1..574: note = derived and/or modified protein sequence (wt) from HRSV__AGG39454.1__F0
MELPILKINAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8895 - protein, 574 aa, synthetic construct
  REGION 1..574: note = derived and/or modified protein sequence (wt) from HRSV__AGG39442.1__F0
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTFNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8896 - protein, 574 aa, synthetic construct
  REGION 1..574: note = derived and/or modified protein sequence (wt) from HRSV__AGG39439.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQMSGINNIAFSN

SEQ ID NO: 8897 - protein, 574 aa, synthetic construct
  REGION 1..574: note = derived and/or modified protein sequence (wt) from HRSV__AGG39436.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTFNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8898 - protein, 574 aa, synthetic construct
  REGION 1..574: note = derived and/or modified protein sequence (wt) from HRSV__AGG39415.1__F0
MDLPILKTNAITTILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8899 - protein, 574 aa, synthetic construct
  REGION 1..574: note = derived and/or modified protein sequence (wt) from HRSV__AGG39403.1__F0
MELPILKTNAITTILAAVTLCFASSQNITEEFYQSTCSAVSKGYLSALRTGWYTSVITIELSNIKENMCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8900 - protein, 574 aa, synthetic construct
  REGION 1..574: note = derived and/or modified protein sequence (wt) from HRSV__AGG39412.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSK

SEQ ID NO: 8901 - protein, 574 aa, synthetic construct
  REGION 1..574: note = derived and/or modified protein sequence (wt) from HRSV__AGG39397.1__F0
MELPIIKANAITTILIAVTFCFASSQNITEEFYQSTCSAVSKGYLSALRTGWYTSVITIELSNIKENKCNGTDAKVKLIKQELDKYKNAVTELQLLMQSTTAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8902 - protein, 574 aa, synthetic construct
  REGION 1..574: note = derived and/or modified protein sequence (wt) from HRSV__AGG39391.1__F0
MDLPILKTNAITAILAAVSLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8903 - protein, 574 aa, synthetic construct
  REGION 1..574: note = derived and/or modified protein sequence (wt) from HRSV__AGG39385.1__F0
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8904 - protein, 574 aa, synthetic construct
  REGION 1..574: note = derived and/or modified protein sequence (wt) from HRSV__AGG39379.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 8905 - protein, 574 aa, synthetic construct
  REGION 1..574: note = derived and/or modified protein sequence (wt) from HRSV__AHL84194.1__F0
MELLILKANAITTILTAVTFCFASGQNITEEFYQSTCSAVSKGYLSALRTGWYTSVITIELSNIKKNKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8906 - protein, 574 aa, synthetic construct
  REGION 1..574: note = derived and/or modified protein sequence (wt) from HRSV__AHA84012.1__F0
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAANNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMMTAIIIVIIVVLLSLIAIGLLLYCKAKNTPVTLSKDQLSGINNIAFSK

SEQ ID NO: 8907 - protein, 574 aa, synthetic construct
  REGION 1..574: note = derived and/or modified protein sequence (wt) from HRSV__AHJ60043.1__F0
MELLIHRSSAIFLTLAINALYLTSSQNITEEFYQSTCSAVSRGYFSALRTGWYTSVITIELSNITETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRIFNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRKSDELLHNVNTGKSTTNIMITTIIIVIIVVLLSLIAIGLLLYCKAKNTPVTLSKDQLSGINNIAFSK

SEQ ID NO: 8908 - protein, 574 aa, synthetic construct
  REGION 1..574: note = derived and/or modified protein sequence (wt) from HRSV__BAO49770.1__F0
MELPILKTNAITTILAAVTLCFASSQNITEEFYQSTCSAVSKGYLSALRTGGYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSAPLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8909 - protein, 574 aa, synthetic construct
  REGION 1..574: note = derived and/or modified protein sequence (wt) from HRSV__BAO49766.1__F0
MELPILKTNAITTILAAVTLCFASSQNITEEFYQSTCSAVSKGYLSALRTGWYTSVITIELSNIKENKCNGPDAKVKLIKQELDKYKNAVTELQLLMQSTPAGNSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8910 - protein, 574 aa, synthetic construct
  REGION 1..574: note = derived and/or modified protein sequence (wt) from HRSV__BAO49767.1__F0
MELPILKTNAITTILAAVTLCFASSQNITEEFYQSTCSAVCKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8911 - protein, 574 aa, synthetic construct
  REGION 1..574: note = derived and/or modified protein sequence (wt) from HRSV__AHA84034.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVDLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8912 - protein, 574 aa, synthetic construct
  REGION 1..574: note = derived and/or modified protein sequence (wt) from HRSV__AHA84023.1__F0
MELPILKTNAITTIFATVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8913 - protein, 574 aa, synthetic construct
  REGION 1..574: note = derived and/or modified protein sequence (wt) from HRSV__AHA83990.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRIFNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8914 - protein, 574 aa, synthetic construct
  REGION 1..574: note = derived and/or modified protein sequence (wt) from HRSV__AHA83957.1__F0
MELPILKTNAITTILAVVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 8915 - protein, 574 aa, synthetic construct
  REGION 1..574: note = derived and/or modified protein sequence (wt) from HRSV__AHA83924.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNIPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNFYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8916 - protein, 574 aa, synthetic construct
  REGION 1..574: note = derived and/or modified protein sequence (wt) from HRSV__AHA83891.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINATKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8917 - protein, 574 aa, synthetic construct
  REGION 1..574: note = derived and/or modified protein sequence (wt) from HRSV__AHA83880.1__F0
MDLPILKINAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8918 - protein, 574 aa, synthetic construct
  REGION 1..574: note = derived and/or modified protein sequence (wt) from HRSV__AHA83782.1__F0
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8919 - protein, 574 aa, synthetic construct
  REGION 1..574: note = derived and/or modified protein sequence (wt) from HRSV__AHA83760.1__F0
MELPIINTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYMDKQLLPIVNKQSCSISNIETVIEFQQKNNRLLEITREFSVNAGVTTPVSTYMLTNNELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8920 - protein, 574 aa, synthetic construct
  REGION 1..574: note = derived and/or modified protein sequence (wt) from HRSV__AHA83694.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSDVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8921 - protein, 574 aa, synthetic construct
  REGION 1..574: note = derived and/or modified protein sequence (wt) from HRSV__AGT75357.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTIPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8922 - protein, 574 aa, synthetic construct
  REGION 1..574: note = derived and/or modified protein sequence (wt) from HRSV__AGN92848.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTINNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLLFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 8923 - protein, 574 aa, synthetic construct
  REGION 1..574: note = derived and/or modified protein sequence (wt) from HRSV__AGN28792.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8924 - protein, 574 aa, synthetic construct
  REGION 1..574: note = derived and/or modified protein sequence (wt) from HRSV__AGN28781.1__F0
MELLIHRSSAIFLTLAINALYLTSSQNITEEFYQSTCSAVSRGYFSALRTGWYTSVITIELSNIKEIKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8925 - protein, 574 aa, synthetic construct
  REGION 1..574: note = derived and/or modified protein sequence (wt) from HRSV__AGN28759.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNIPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8926 - protein, 574 aa, synthetic construct
  REGION 1..574: note = derived and/or modified protein sequence (wt) from HRSV__AGN28748.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNINTGKSTTNIMITAIIIVIIVVLLSLIAIGLLLYCKAKNTPVTLSKDQLSGINNIAFSK

SEQ ID NO: 8927 - protein, 574 aa, synthetic construct
  REGION 1..574: note = derived and/or modified protein sequence (wt) from HRSV__AGN28693.1__F0
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKKLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8928 - protein, 574 aa, synthetic construct
  REGION 1..574: note = derived and/or modified protein sequence (wt) from HRSV__AGN28638.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAQNTPVTLSKDQLSGINNIAFSK

SEQ ID NO: 8929 - protein, 574 aa, synthetic construct
  REGION 1..574: note = derived and/or modified protein sequence (wt) from HRSV__AGN28627.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIREGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8930 - protein, 574 aa, synthetic construct
  REGION 1..574: note = derived and/or modified protein sequence (wt) from HRSV__AGN28539.1__F0
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8931 - protein, 574 aa, synthetic construct
  REGION 1..574: note = derived and/or modified protein sequence (wt) from HRSV__AGN28528.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREASQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8932 - protein, 574 aa, synthetic construct
  REGION 1..574: note = derived and/or modified protein sequence (wt) from HRSV__AGN28462.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 8933 - protein, 574 aa, synthetic construct
  REGION 1..574: note = derived and/or modified protein sequence (wt) from HRSV__AGL96787.1__F0
MEVPILKTNAITTILTAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTANIMITTIIIVIIVILLALIAVGLLLYCKARSTPVTLSKDQLSGINNIAFSN

SEQ ID NO: 8934 - protein, 574 aa, synthetic construct
  REGION 1..574: note = derived and/or modified protein sequence (wt) from HRSV__AGL96786.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKTDELLHNVNAGKSTTNIMITTIIIVIIVILLALIAVGLLLYCKARSTPVTLSKDQLSGINNIAFSN

SEQ ID NO: 8935 - protein, 574 aa, synthetic construct
  REGION 1..574: note = derived and/or modified protein sequence (wt) from HRSV__AGL96784.1__F0
MELPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQTETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCRARSTPVTLSKDQLSGINNIAFSN

SEQ ID NO: 8936 - protein, 571 aa, synthetic construct
  REGION 1..571: note = derived and/or modified protein sequence (wt) from HRSV__AHG54517.1__F0
MELLIHRSSAIFLTLAINALYLTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGVIAVS

SEQ ID NO: 8937 - protein, 574 aa, synthetic construct
  REGION 1..574: note = derived and/or modified protein sequence (wt) from HRSV(Memphis-37)__AIY60640.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8938 - protein, 574 aa, synthetic construct
  REGION 1..574: note = derived and/or modified protein sequence (wt) from HRSV__ABQ42594.1__F0
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNVGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8939 - protein, 574 aa, synthetic construct
  REGION 1..574: note = derived and/or modified protein sequence (wt) from HRSV__ACO83297.1__F0
MELPILKANAITTILAAVTFCFASSQNITEEFYQSTCSAVSKGYLSALRTGWYTSVITIELSNIKKNKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSRVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAEKCKVQSNRVFCDTMYSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPITLSKDQLSGINNIAFSN

SEQ ID NO: 8940 - protein, 574 aa, synthetic construct
  REGION 1..574: note = derived and/or modified protein sequence (wt) from HRSV__ACO83301.1__F0
MELLILKANAITTILTAVTFCFASGQNITEEFYQSTCSAVSKGYLSALRTGWYTSVITIELSNIKKNKCNGTDAKIKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKARSTPVTLSKDQLSGINNIAFSN

SEQ ID NO: 8941 - protein, 574 aa, synthetic construct
  REGION 1..574: note = derived and/or modified protein sequence (wt) from HRSV__ADZ95775.1__F0
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAVNNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKELMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8942 - protein, 574 aa, synthetic construct
  REGION 1..574: note = derived and/or modified protein sequence (wt) from HRSV__ADZ95779.1__F0
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMLSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8943 - protein, 574 aa, synthetic construct
  REGION 1..574: note = derived and/or modified protein sequence (wt) from HRSV__AEQ63597.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKIQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8944 - protein, 574 aa, synthetic construct
  REGION 1..574: note = derived and/or modified protein sequence (wt) from HRSV__AEQ63608.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPTANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8945 - protein, 574 aa, synthetic construct
  REGION 1..574: note = derived and/or modified protein sequence (wt) from HRSV__AEQ63630.1__F0
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNARVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 8946 - protein, 574 aa, synthetic construct
  REGION 1..574: note = derived and/or modified protein sequence (wt) from HRSV__AHE57683.1__F0
MDLPILKTNAITAILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8947 - protein, 574 aa, synthetic construct
  REGION 1..574: note = derived and/or modified protein sequence (wt) from HRSV__AHE57894.1__F0
MDLPILKTNAITAILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITIDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8948 - protein, 574 aa, synthetic construct
  REGION 1..574: note = derived and/or modified protein sequence (wt) from HRSV__AHW80511.1__F0
MELPILKTNAITTILAAVTLCFASSQNITEEFYQSTCSAVSKGYLSALRTGWYTSVITIELSTIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTKIMITTIIIVIIVILLSLIAVGLLLYCKARSTPVTLSKDQLSGINNIAFSS

SEQ ID NO: 8949 - protein, 574 aa, synthetic construct
  REGION 1..574: note = derived and/or modified protein sequence (wt) from HRSV__AHW80560.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8950 - protein, 574 aa, synthetic construct
  REGION 1..574: note = derived and/or modified protein sequence (wt) from HRSV__AHW80660.1__F0
MDLPILKTNAITAILAAVSLCLASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8951 - protein, 574 aa, synthetic construct
  REGION 1..574: note = derived and/or modified protein sequence (wt) from HRSV__AHW80670.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPITLSKDQLSGINNIAFSN

SEQ ID NO: 8952 - protein, 574 aa, synthetic construct
  REGION 1..574: note = derived and/or modified protein sequence (wt) from HRSV__AHW80760.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8953 - protein, 574 aa, synthetic construct
  REGION 1..574: note = derived and/or modified protein sequence (wt) from HRSV__AHW80800.1__F0
MDLPILKTNAITTILAAVTLCIASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8954 - protein, 574 aa, synthetic construct
  REGION 1..574: note = derived and/or modified protein sequence (wt) from HRSV__AHW80860.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRLMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8955 - protein, 574 aa, synthetic construct
  REGION 1..574: note = derived and/or modified protein sequence (wt) from HRSV__AHW80990.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKLKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8956 - protein, 574 aa, synthetic construct
  REGION 1..574: note = derived and/or modified protein sequence (wt) from HRSV__AHW81370.1__F0
MELPILKTNAITTILAAVALCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8957 - protein, 574 aa, synthetic construct
  REGION 1..574: note = derived and/or modified protein sequence (wt) from HRSV__AHX22013.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFIGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8958 - protein, 574 aa, synthetic construct
  REGION 1..574: note = derived and/or modified protein sequence (wt) from HRSV__AIA62675.1__F0
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFFLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8959 - protein, 574 aa, synthetic construct
  REGION 1..574: note = derived and/or modified protein sequence (wt) from HRSV__AIA62685.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFFLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8960 - protein, 574 aa, synthetic construct
  REGION 1..574: note = derived and/or modified protein sequence (wt) from HRSV__AIA63044.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSPYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8961 - protein, 574 aa, synthetic construct
  REGION 1..574: note = derived and/or modified protein sequence (wt) from HRSV__AIA63234.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFFNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8962 - protein, 574 aa, synthetic construct
  REGION 1..574: note = derived and/or modified protein sequence (wt) from HRSV__AIA63364.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSITDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8963 - protein, 574 aa, synthetic construct
  REGION 1..574: note = derived and/or modified protein sequence (wt) from HRSV__AIA63604.1__F0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQVSGINNIAFSN

SEQ ID NO: 8964 - protein, 574 aa, synthetic construct
  REGION 1..574: note = derived and/or modified protein sequence (wt) from HRSV__AUH26189.1__F0
MDLPILKTNAITAILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKRLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8965 - protein, 574 aa, synthetic construct
  REGION 1..574: note = derived and/or modified protein sequence (wt) from HRSV__NP_044596.1__F0
MELPILKTNAITAILAAVTLCFASSQNITEEFYQTTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 8966 - protein, 574 aa, synthetic construct
  REGION 1..574: note = derived and/or modified protein sequence (wt) from HRSV__1701388A__F0
MELPILKTNTITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKARSTPVTLSKDQLSGINNIAFSN

SEQ ID NO: 8967 - protein, 574 aa, synthetic construct
  REGION 1..574: note = derived and/or modified protein sequence (wt) from HRSV__WP_079890144.1__F0
MELLILKANAITTILTAVTFCFASGQNITEEFYQSTCSAVSKGYLSALRTGWYTSVITIELSNIKKIKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNVGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8968 - protein, 568 aa, synthetic construct
  REGION 1..568: note = derived and/or modified protein sequence (wt) from HRSV__AJF44801.1__F-del
MIPQARTKLNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8969 - protein, 568 aa, synthetic construct
  REGION 1..568: note = derived and/or modified protein sequence (wt) from HRSV__AJF44759.1__F-del
MIPQARTKLNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTRSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8970 - protein, 568 aa, synthetic construct
  REGION 1..568: note = derived and/or modified protein sequence (wt) from HRSV__AJF44661.1__F-del
MIPQARTELNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWELHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8971 - protein, 568 aa, synthetic construct
  REGION 1..568: note = derived and/or modified protein sequence (wt) from HRSV__AJF44602.1__F-del
MIPQARTELNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8972 - protein, 553 aa, synthetic construct
  REGION 1..553: note = derived and/or modified protein sequence (wt) from HRSV__2207424A__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTSTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLFLYCKAR

SEQ ID NO: 8973 - protein, 553 aa, synthetic construct
  REGION 1..553: note = derived and/or modified protein sequence (wt) from HRSV__AAB38520.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVLCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLLLYCKAR

SEQ ID NO: 8974 - protein, 553 aa, synthetic construct
  REGION 1..553: note = derived and/or modified protein sequence (wt) from HRSV__AAB38517.1__F-del
MELPILKTNAITAILAAVTLCFASGQNITEEFYQSTCSAVSKGYLSALRTGWYTSVITIELSNIKENKCNGTDAKVKLIKQELDKYKSAVTELQLLTQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTSTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 8975 - protein, 553 aa, synthetic construct
  REGION 1..553: note = derived and/or modified protein sequence (wt) from HRSV__AAB38519.1__F-del
MELPILKTNAITTILAAVTLCFASSQNITEEFYQSTCSVVSKGYLSALRIGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKTYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVLCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLLLYCKAR

SEQ ID NO: 8976 - protein, 553 aa, synthetic construct
  REGION 1..553: note = derived and/or modified protein sequence (wt) from HRSV__AAB38518.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKKTNVTLSKKRKRRFLGFLLGVGSATASGIAVSKVLHLEGEVNKIKSALLTTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTSTDRGWYCDNAGSVSFFPQADTCKVQSNRVFWDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 8977 - protein, 553 aa, synthetic construct
  REGION 1..553: note = derived and/or modified protein sequence (wt) from HRSV__AVQ93587.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLVSLIAIGLLLYCKAK

SEQ ID NO: 8978 - protein, 553 aa, synthetic construct
  REGION 1..553: note = derived and/or modified protein sequence (wt) from HRSV__AVQ93599.1__F-del
MELLIHRSSAIFLTLVINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLTVSISKKRKRRFLGFLLGVGSAIASGIAVSKVLHLEGEVNKIKNALQSTNKAVVSLSNGVSVLTSKVLDLKNYINSQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8979 - protein, 553 aa, synthetic construct
  REGION 1..553: note = derived and/or modified protein sequence (wt) from HRSV__AVQ93571.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKFMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNFYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8980 - protein, 553 aa, synthetic construct
  REGION 1..553: note = derived and/or modified protein sequence (wt) from HRSV__AVQ93568.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMTTAIIIVIIVVLLSLIAIGLLLYCKAK

SEQ ID NO: 8981 - protein, 553 aa, synthetic construct
  REGION 1..553: note = derived and/or modified protein sequence (wt) from HRSV__AVQ93589.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLVSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8982 - protein, 553 aa, synthetic construct
  REGION 1..553: note = derived and/or modified protein sequence (wt) from HRSV__AVQ93597.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPVVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8983 - protein, 553 aa, synthetic construct
  REGION 1..553: note = derived and/or modified protein sequence (wt) from HRSV__AVQ93563.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNACVTTPLSTYMLTNSELLSLINDMPITNDQKKLMSSNVQIVRLQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8984 - protein, 553 aa, synthetic construct
  REGION 1..553: note = derived and/or modified protein sequence (wt) from HRSV__AVQ93594.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8985 - protein, 553 aa, synthetic construct
  REGION 1..553: note = derived and/or modified protein sequence (wt) from HRSV__AVQ93601.1__F-del
MELLIHRSSAIFLTLAINALYPTSSQNITEEFYQSTCSAVSRGYLSALRTGWYTSVITIELSNIKETNCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8986 - protein, 553 aa, synthetic construct
  REGION 1..553: note = derived and/or modified protein sequence (wt) from HRSV__AVQ93562.1__F-del
MELLIHRSSAIFLTFAINALYFTSSQNITEEFYQSTCSAVSRGYLSALRTGWYTSVITIELSNIKETKCNGTDTKVKLIKQELDKYKNAVTELQLLMQNTPAVNNRARREAPQYMDYTINTSKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEGVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLMLYCKAK

SEQ ID NO: 8987 - protein, 553 aa, synthetic construct
  REGION 1..553: note = derived and/or modified protein sequence (wt) from HRSV__AVQ93561.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQGYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8988 - protein, 553 aa, synthetic construct
  REGION 1..553: note = derived and/or modified protein sequence (wt) from HRSV__AVQ93607.1__F-del
MELLIHRSSAIFLTLAINALYPTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCNYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8989 - protein, 553 aa, synthetic construct
  REGION 1..553: note = derived and/or modified protein sequence (wt) from HRSV__AVQ93588.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAVGLLLYCKAK

SEQ ID NO: 8990 - protein, 553 aa, synthetic construct
  REGION 1..553: note = derived and/or modified protein sequence (wt) from HRSV__AVQ93575.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKVK

SEQ ID NO: 8991 - protein, 553 aa, synthetic construct
  REGION 1..553: note = derived and/or modified protein sequence (wt) from HRSV__AVQ93468.1__F-del
MELPILKTNAITPILAAVTLCFAFSQNITEEFIQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 8992 - protein, 553 aa, synthetic construct
  REGION 1..553: note = derived and/or modified protein sequence (wt) from HRSV__AVQ93467.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCENAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 8993 - protein, 553 aa, synthetic construct
  REGION 1..553: note = derived and/or modified protein sequence (wt) from HRSV__AVQ93590.1__F-del
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAVNNRARREAPQYMDYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8994 - protein, 553 aa, synthetic construct
  REGION 1..553: note = derived and/or modified protein sequence (wt) from HRSV__AVQ93552.1__F-del
MELLIHRSSAIFLTLAINALYPTSSQNITEEFYQSTCSAVSRGYLSALRTGWYTSVITIELSNIKETKCNGTDTKVKLIKQELDKYKNAVTELQLLMQNTPAVNNRARREALQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8995 - protein, 553 aa, synthetic construct
  REGION 1..553: note = derived and/or modified protein sequence (wt) from HRSV__AVQ93556.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVNTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 8996 - protein, 553 aa, synthetic construct
  REGION 1..553: note = derived and/or modified protein sequence (wt) from HRSV__AVQ93471.1__F-del
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTRNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 8997 - protein, 553 aa, synthetic construct
  REGION 1..553: note = derived and/or modified protein sequence (wt) from HRSV__AVQ93458.1__F-del
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 8998 - protein, 553 aa, synthetic construct
  REGION 1..553: note = derived and/or modified protein sequence (wt) from HRSV__AVQ93494.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKIRKRRFLGFLLGVGSAIASGIAVSKVLHLEGEVNKIKSALLSTNKAVVSLSNGISVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 8999 - protein, 553 aa, synthetic construct
  REGION 1..553: note = derived and/or modified protein sequence (wt) from HRSV__AVQ93470.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVSKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTANIMITTIIIVIIVILLALIAVGLLLYCKAR

SEQ ID NO: 9000 - protein, 553 aa, synthetic construct
  REGION 1..553: note = derived and/or modified protein sequence (wt) from HRSV__AVQ93489.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPVVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9001 - protein, 553 aa, synthetic construct
  REGION 1..553: note = derived and/or modified protein sequence (wt) from HRSV__AVQ93542.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNSRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9002 - protein, 553 aa, synthetic construct
  REGION 1..553: note = derived and/or modified protein sequence (wt) from HRSV__AVQ93472.1__F-del
MELPILKTNAITTIFAAVTLCFSSSQNITEKFYQSTCSAVSKGYLSALRTGWYTSVITIKLSNIKENKCNGTDAKVKLIKQELHKYKNAVTELQLLMQSTPPANNRARRELPRFMNYTLNNTKNNNVTLIKKRKRTFLGFLLGVGSAIASGIAVSKVLHLQGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9003 - protein, 553 aa, synthetic construct
  REGION 1..553: note = derived and/or modified protein sequence (wt) from HRSV__AVQ93514.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNSRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9004 - protein, 553 aa, synthetic construct
  REGION 1..553: note = derived and/or modified protein sequence (wt) from HRSV__AVQ93485.1__F-del
MELPILKTNAITTILAAVTLCFASSQNITEEFYQSTCSAVSKGYLSALRTGWYTSVITIELSNIKENKCNGTDAKVKLIKQELDKYKNAVTKLQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTNEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9005 - protein, 553 aa, synthetic construct
  REGION 1..553: note = derived and/or modified protein sequence (wt) from HRSV__AVQ93533.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKIHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9006 - protein, 553 aa, synthetic construct
  REGION 1..553: note = derived and/or modified protein sequence (wt) from HRSV__AVQ93481.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCTIMTSKTDVSSSVITSIGAIVSWYGKTKCTASNKNRGIIKTFCNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLISCKAR

SEQ ID NO: 9007 - protein, 553 aa, synthetic construct
  REGION 1..553: note = derived and/or modified protein sequence (wt) from HRSV__AVQ93546.1__F-del
MELLIHRSNAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9008 - protein, 553 aa, synthetic construct
  REGION 1..553: note = derived and/or modified protein sequence (wt) from HRSV__AVQ93512.1__F-del
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINLYDPLVFPSDEFDASISQVNEKINQSLAFIRKSDELLHNVNAGKSTTNIMITTIIIVIIVILLALIAVGLLLYCKAR

SEQ ID NO: 9009 - protein, 553 aa, synthetic construct
  REGION 1..553: note = derived and/or modified protein sequence (wt) from HRSV__AVQ93554.1__F-del
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAVNNRARREAPQYMDYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLMLYCKAK

SEQ ID NO: 9010 - protein, 553 aa, synthetic construct
  REGION 1..553: note = derived and/or modified protein sequence (wt) from HRSV__AVQ93551.1__F-del
MELLIHRSSAIFLTLAINALYPTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9011 - protein, 553 aa, synthetic construct
  REGION 1..553: note = derived and/or modified protein sequence (wt) from HRSV__AVQ93547.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAINNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9012 - protein, 553 aa, synthetic construct
  REGION 1..553: note = derived and/or modified protein sequence (wt) from HRSV__AVQ93558.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLYVSISKKRKRRFLGFLLGVGSAIASGIAVSKVLHLEGEVNKIKNALQSTNKAVVSLSNGVSVLTSKVLDLKNYINSQLLPIVNKQSCRISNIETVIEFQQKNSRLLEITREFSVNAGVTTPLSTYMLTNSELLSLIIDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9013 - protein, 553 aa, synthetic construct
  REGION 1..553: note = derived and/or modified protein sequence (wt) from HRSV__AVQ93461.1__F-del
MESPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9014 - protein, 553 aa, synthetic construct
  REGION 1..553: note = derived and/or modified protein sequence (wt) from HRSV__AVQ93500.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSISFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9015 - protein, 553 aa, synthetic construct
  REGION 1..553: note = derived and/or modified protein sequence (wt) from HRSV__AVQ93426.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLYNVNAGKSTTNIMITTIIIVIIVILLALIAVGLLLYCKAR

SEQ ID NO: 9016 - protein, 553 aa, synthetic construct
  REGION 1..553: note = derived and/or modified protein sequence (wt) from HRSV__AVQ93398.1__F-del
MELPILKINAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9017 - protein, 553 aa, synthetic construct
  REGION 1..553: note = derived and/or modified protein sequence (wt) from HRSV__AVQ93401.1__F-del
MELPILKTNAITTILAAVTLYFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9018 - protein, 553 aa, synthetic construct
  REGION 1..553: note = derived and/or modified protein sequence (wt) from HRSV__AVQ93361.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSAPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9019 - protein, 553 aa, synthetic construct
  REGION 1..553: note = derived and/or modified protein sequence (wt) from HRSV__AVQ93408.1__F-del
MELPISKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYNPLVFPSDEFDASISQVNEKINQSLAFIRKSDELLHNVNAGKSTTNIMITTIIIVIIVILLALIAVGLLLYCKAR

SEQ ID NO: 9020 - protein, 553 aa, synthetic construct
  REGION 1..553: note = derived and/or modified protein sequence (wt) from HRSV__AVQ93443.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9021 - protein, 553 aa, synthetic construct
  REGION 1..553: note = derived and/or modified protein sequence (wt) from HRSV__AVQ93429.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9022 - protein, 553 aa, synthetic construct
  REGION 1..553: note = derived and/or modified protein sequence (wt) from HRSV__AVQ93359.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9023 - protein, 553 aa, synthetic construct
  REGION 1..553: note = derived and/or modified protein sequence (wt) from HRSV__AVQ93365.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAVNSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9024 - protein, 553 aa, synthetic construct
  REGION 1..553: note = derived and/or modified protein sequence (wt) from HRSV__AVQ93366.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIIRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9025 - protein, 553 aa, synthetic construct
  REGION 1..553: note = derived and/or modified protein sequence (wt) from HRSV__AVQ93402.1__F-del
MELPILKTNTITTILAAVTLCFASSQNITEEFYQSTCSAVSKGYLIALRTGWYTNVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9026 - protein, 553 aa, synthetic construct
  REGION 1..553: note = derived and/or modified protein sequence (wt) from HRSV__AVQ93377.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLFLYCKAR

SEQ ID NO: 9027 - protein, 553 aa, synthetic construct
  REGION 1..553: note = derived and/or modified protein sequence (wt) from HRSV__AVQ93412.1__F-del
MELPILKTNAITIILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTSVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNINIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9028 - protein, 553 aa, synthetic construct
  REGION 1..553: note = derived and/or modified protein sequence (wt) from HRSV__AVQ93391.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9029 - protein, 553 aa, synthetic construct
  REGION 1..553: note = derived and/or modified protein sequence (wt) from HRSV__AVQ93457.1__F-del
MELPILKTNAITTILAAVTLCIASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9030 - protein, 553 aa, synthetic construct
  REGION 1..553: note = derived and/or modified protein sequence (wt) from HRSV__AVQ93372.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYNPLVFPSDEFDASISQVNEKINQSLAFIRKSDELLHNVNAGKSTTNIMITTIIIVIIVILLALIAVGLLLYCKAR

SEQ ID NO: 9031 - protein, 553 aa, synthetic construct
  REGION 1..553: note = derived and/or modified protein sequence (wt) from HRSV__AVQ93455.1__F-del
MELPIFKTNAITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9032 - protein, 553 aa, synthetic construct
  REGION 1..553: note = derived and/or modified protein sequence (wt) from HRSV__AVQ93364.1__F-del
MELPILKTNAITTILAVVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIIRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9033 - protein, 553 aa, synthetic construct
  REGION 1..553: note = derived and/or modified protein sequence (wt) from HRSV__AVQ93378.1__F-del
MQLPILKIYAITSILAAVTLYFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9034 - protein, 553 aa, synthetic construct
  REGION 1..553: note = derived and/or modified protein sequence (wt) from HRSV__AVQ93393.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGKPIINFYDPLVFPSDEFDASISQVNEKINQSLAFIRKSDELLHNVNAGKSTTNIMITTIIIVIIVILLALIAVGLLLYCKAR

SEQ ID NO: 9035 - protein, 553 aa, synthetic construct
  REGION 1..553: note = derived and/or modified protein sequence (wt) from HRSV__AVQ93362.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQLNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9036 - protein, 553 aa, synthetic construct
  REGION 1..553: note = derived and/or modified protein sequence (wt) from HRSV__AVQ93585.1__F-del
MELLIHRSSAIFLTLVINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9037 - protein, 553 aa, synthetic construct
  REGION 1..553: note = derived and/or modified protein sequence (wt) from HRSV__ART28504.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9038 - protein, 553 aa, synthetic construct
  REGION 1..553: note = derived and/or modified protein sequence (wt) from HRSV__AVQ93404.1__F-del
MELPISKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9039 - protein, 553 aa, synthetic construct
  REGION 1..553: note = derived and/or modified protein sequence (wt) from HRSV__AOS49123.1__F-del
MELPILKTNTITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9040 - protein, 553 aa, synthetic construct
  REGION 1..553: note = derived and/or modified protein sequence (wt) from HRSV__AOS48496.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9041 - protein, 553 aa, synthetic construct
  REGION 1..553: note = derived and/or modified protein sequence (wt) from HRSV__AMT78271.1__F-del
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9042 - protein, 553 aa, synthetic construct
  REGION 1..553: note = derived and/or modified protein sequence (wt) from HRSV__AHX57174.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGKPIINFYDPLVFPSDEFDASISQVNEKINQSLAFIRKSDELLHNVNAGKSTTNIMITTIIIVIIVILLALIAVGLLLYCKAR

SEQ ID NO: 9043 - protein, 553 aa, synthetic construct
  REGION 1..553: note = derived and/or modified protein sequence (wt) from HRSV__AHW81390.1__F-del
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9044 - protein, 553 aa, synthetic construct
  REGION 1..553: note = derived and/or modified protein sequence (wt) from HRSV__AHV81506.1__F-del
MELPILKTNAIITILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9045 - protein, 553 aa, synthetic construct
  REGION 1..553: note = derived and/or modified protein sequence (wt) from HRSV__AFX60128.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9046 - protein, 553 aa, synthetic construct
  REGION 1..553: note = derived and/or modified protein sequence (wt) from HRSV__AFX60129.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9047 - protein, 553 aa, synthetic construct
  REGION 1..553: note = derived and/or modified protein sequence (wt) from HRSV__AEQ63389.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9048 - protein, 553 aa, synthetic construct
  REGION 1..553: note = derived and/or modified protein sequence (wt) from HRSV__ARB66328.1__F-del
MELPILKTNAITTILAAVTLCFASSQNITEEFYQSTCSAVSKGYLSALRTGWYTSVITIELSNIRENKCNGTDAKVKLIKQELDKYKNAVTELQLLMQSTPAASSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDTSISQVNEKINQSLAFIRKSDELLHNVNAGKSTTNIMITTIIIVIIVILLALIAVGLLLYCKAK

SEQ ID NO: 9049 - protein, 553 aa, synthetic construct
  REGION 1..553: note = derived and/or modified protein sequence (wt) from HRSV__ANZ80034.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAASSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9050 - protein, 553 aa, synthetic construct
  REGION 1..553: note = derived and/or modified protein sequence (wt) from HRSV__AMN91253.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9051 - protein, 553 aa, synthetic construct
  REGION 1..553: note = derived and/or modified protein sequence (wt) from HRSV__P03420.1__F-del
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9052 - protein, 553 aa, synthetic construct
  REGION 1..553: note = derived and/or modified protein sequence (wt) from HRSV__AIO08046.1__F-del
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9053 - protein, 553 aa, synthetic construct
  REGION 1..553: note = derived and/or modified protein sequence (wt) from HRSV__NP_056863.1__F-del
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9054 - protein, 553 aa, synthetic construct
  REGION 1..553: note = derived and/or modified protein sequence (wt) from HRSV__AFX60234.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9055 - protein, 553 aa, synthetic construct
  REGION 1..553: note = derived and/or modified protein sequence (wt) from HRSV__AFX60231.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTRNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9056 - protein, 553 aa, synthetic construct
  REGION 1..553: note = derived and/or modified protein sequence (wt) from HRSV__AFX60232.1__F-del
MELLIYRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9057 - protein, 553 aa, synthetic construct
  REGION 1..553: note = derived and/or modified protein sequence (wt) from HRSV__AFX60222.1__F-del
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQICRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9058 - protein, 553 aa, synthetic construct
  REGION 1..553: note = derived and/or modified protein sequence (wt) from HRSV__AFX60219.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITAIIIVIIVVLLSLIAIGLLLYCKAK

SEQ ID NO: 9059 - protein, 553 aa, synthetic construct
  REGION 1..553: note = derived and/or modified protein sequence (wt) from HRSV__AFX60215.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9060 - protein, 553 aa, synthetic construct
  REGION 1..553: note = derived and/or modified protein sequence (wt) from HRSV__AFX60214.1__F-del
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9061 - protein, 553 aa, synthetic construct
  REGION 1..553: note = derived and/or modified protein sequence (wt) from HRSV__AFX60212.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9062 - protein, 553 aa, synthetic construct
  REGION 1..553: note = derived and/or modified protein sequence (wt) from HRSV__AFX60208.1__F-del
MELPILKTNAITTILAAVTLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9063 - protein, 553 aa, synthetic construct
  REGION 1..553: note = derived and/or modified protein sequence (wt) from HRSV__AFX60202.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9064 - protein, 553 aa, synthetic construct
  REGION 1..553: note = derived and/or modified protein sequence (wt) from HRSV__AFX60220.1__F-del
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9065 - protein, 553 aa, synthetic construct
  REGION 1..553: note = derived and/or modified protein sequence (wt) from HRSV__AFX60213.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9066 - protein, 553 aa, synthetic construct
  REGION 1..553: note = derived and/or modified protein sequence (wt) from HRSV__AFX60190.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9067 - protein, 553 aa, synthetic construct
  REGION 1..553: note = derived and/or modified protein sequence (wt) from HRSV__AFX60187.1__F-del
MELPILKTNAITTILAAVTLCFSSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9068 - protein, 553 aa, synthetic construct
  REGION 1..553: note = derived and/or modified protein sequence (wt) from HRSV__AFX60201.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKAR

SEQ ID NO: 9069 - protein, 553 aa, synthetic construct
  REGION 1..553: note = derived and/or modified protein sequence (wt) from HRSV__AFX60173.1__F-del
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTSIMITTIIIVIIVILLSLIAVGLLLYCKAR

SEQ ID NO: 9070 - protein, 553 aa, synthetic construct
  REGION 1..553: note = derived and/or modified protein sequence (wt) from HRSV__AFX60169.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPSANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9071 - protein, 553 aa, synthetic construct
  REGION 1..553: note = derived and/or modified protein sequence (wt) from HRSV__AFX60162.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9072 - protein, 553 aa, synthetic construct
  REGION 1..553: note = derived and/or modified protein sequence (wt) from HRSV__AFX60156.1__F-del
MELPILKANAITTILAAVILCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKAR

SEQ ID NO: 9073 - protein, 553 aa, synthetic construct
  REGION 1..553: note = derived and/or modified protein sequence (wt) from HRSV__AFX60151.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSILNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9074 - protein, 553 aa, synthetic construct
  REGION 1..553: note = derived and/or modified protein sequence (wt) from HRSV__AFX60150.1__F-del
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9075 - protein, 553 aa, synthetic construct
  REGION 1..553: note = derived and/or modified protein sequence (wt) from HRSV__AFX60148.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISLVNEKINQSLAFIRKSDELLHNVNAGKSTTNIMITTIIIVIIVILLALIAVGLLLYCKAR

SEQ ID NO: 9076 - protein, 553 aa, synthetic construct
  REGION 1..553: note = derived and/or modified protein sequence (wt) from HRSV__AFX60127.1__F-del
MELPILKANAITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKAR

SEQ ID NO: 9077 - protein, 553 aa, synthetic construct
  REGION 1..553: note = derived and/or modified protein sequence (wt) from HRSV__AFX60137.1__F-del
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNKKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9078 - protein, 553 aa, synthetic construct
  REGION 1..553: note = derived and/or modified protein sequence (wt) from HRSV__AFX60135.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGTAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9079 - protein, 553 aa, synthetic construct
  REGION 1..553: note = derived and/or modified protein sequence (wt) from HRSV__AFV46420.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNFCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9080 - protein, 553 aa, synthetic construct
  REGION 1..553: note = derived and/or modified protein sequence (wt) from HRSV__AFX60200.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKVGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9081 - protein, 553 aa, synthetic construct
  REGION 1..553: note = derived and/or modified protein sequence (wt) from HRSV__AFV46419.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9082 - protein, 553 aa, synthetic construct
  REGION 1..553: note = derived and/or modified protein sequence (wt) from HRSV__AFV46417.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRTRRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9083 - protein, 553 aa, synthetic construct
  REGION 1..553: note = derived and/or modified protein sequence (wt) from HRSV__AFV46413.1__F-del
MELPILKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9084 - protein, 553 aa, synthetic construct
  REGION 1..553: note = derived and/or modified protein sequence (wt) from HRSV__AFV46414.1__F-del
MELPILKTNAITTILAAITLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9085 - protein, 553 aa, synthetic construct
  REGION 1..553: note = derived and/or modified protein sequence (wt) from HRSV__AFV46410.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPTANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9086 - protein, 553 aa, synthetic construct
  REGION 1..553: note = derived and/or modified protein sequence (wt) from HRSV__AFV46403.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9087 - protein, 553 aa, synthetic construct
  REGION 1..553: note = derived and/or modified protein sequence (wt) from HRSV__AFV46409.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDTSISQVNEKINQSLAFIRKSDELLHNVNAGKSTTNIMITTIIIVIIVILLALIAVGLLLYCKAR

SEQ ID NO: 9088 - protein, 553 aa, synthetic construct
  REGION 1..553: note = derived and/or modified protein sequence (wt) from HRSV__AFP99061.1__F-del
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9089 - protein, 553 aa, synthetic construct
  REGION 1..553: note = derived and/or modified protein sequence (wt) from HRSV__AFM95400.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKNNNVTLSNKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9090 - protein, 553 aa, synthetic construct
  REGION 1..553: note = derived and/or modified protein sequence (wt) from HRSV__AFV46401.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9091 - protein, 553 aa, synthetic construct
  REGION 1..553: note = derived and/or modified protein sequence (wt) from HRSV__AFP99064.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGVAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9092 - protein, 553 aa, synthetic construct
  REGION 1..553: note = derived and/or modified protein sequence (wt) from HRSV__AFM95376.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNEFDASISQVNEKINQSLAFIRKSDELLHNVNAGKSTTNIMITTIIIVIIVILLSLIAVGLLLYCKAR

SEQ ID NO: 9093 - protein, 553 aa, synthetic construct
  REGION 1..553: note = derived and/or modified protein sequence (wt) from HRSV__AFX60138.1__F-del
MELPILKTNSITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9094 - protein, 553 aa, synthetic construct
  REGION 1..553: note = derived and/or modified protein sequence (wt) from HRSV__AFP99060.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9095 - protein, 553 aa, synthetic construct
  REGION 1..553: note = derived and/or modified protein sequence (wt) from HRSV__AFM95365.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKYDELLHNVNAGKSTTNIMITTIIIVIIVILLSLIAVGLLLYCKAR

SEQ ID NO: 9096 - protein, 553 aa, synthetic construct
  REGION 1..553: note = derived and/or modified protein sequence (wt) from HRSV__AFM55563.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9097 - protein, 553 aa, synthetic construct
  REGION 1..553: note = derived and/or modified protein sequence (wt) from HRSV__AFM55530.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNSTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQINEKINQSLAFIRKSDELLHNVNAGKSTTNIMITTIIIVIIVILLALIAVGLLLYCKAR

SEQ ID NO: 9098 - protein, 553 aa, synthetic construct
  REGION 1..553: note = derived and/or modified protein sequence (wt) from HRSV__AFM55442.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9099 - protein, 553 aa, synthetic construct
  REGION 1..553: note = derived and/or modified protein sequence (wt) from HRSV__AFM55420.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPVVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9100 - protein, 553 aa, synthetic construct
  REGION 1..553: note = derived and/or modified protein sequence (wt) from HRSV__AFM55552.1__F-del
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9101 - protein, 553 aa, synthetic construct
  REGION 1..553: note = derived and/or modified protein sequence (wt) from HRSV__AFM55365.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKIHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9102 - protein, 553 aa, synthetic construct
  REGION 1..553: note = derived and/or modified protein sequence (wt) from HRSV__AFP99059.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9103 - protein, 553 aa, synthetic construct
  REGION 1..553: note = derived and/or modified protein sequence (wt) from HRSV__AFM55354.1__F-del
MELPILKTNAITTILAAVTLCFVSSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9104 - protein, 553 aa, synthetic construct
  REGION 1..553: note = derived and/or modified protein sequence (wt) from HRSV__AFM55343.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNANVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9105 - protein, 553 aa, synthetic construct
  REGION 1..553: note = derived and/or modified protein sequence (wt) from HRSV__AFM55387.1__F-del
MELPILKTNAITIILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9106 - protein, 553 aa, synthetic construct
  REGION 1..553: note = derived and/or modified protein sequence (wt) from HRSV__AFM55299.1__F-del
MDLPILKTKAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNNKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9107 - protein, 553 aa, synthetic construct
  REGION 1..553: note = derived and/or modified protein sequence (wt) from HRSV__AFM55288.1__F-del
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9108 - protein, 553 aa, synthetic construct
  REGION 1..553: note = derived and/or modified protein sequence (wt) from HRSV__AFM55266.1__F-del
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9109 - protein, 553 aa, synthetic construct
  REGION 1..553: note = derived and/or modified protein sequence (wt) from HRSV__AFM55277.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9110 - protein, 553 aa, synthetic construct
  REGION 1..553: note = derived and/or modified protein sequence (wt) from HRSV__AFM55255.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYFKAR

SEQ ID NO: 9111 - protein, 553 aa, synthetic construct
  REGION 1..553: note = derived and/or modified protein sequence (wt) from HRSV__AFM55222.1__F-del
MELPILKTNVITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9112 - protein, 553 aa, synthetic construct
  REGION 1..553: note = derived and/or modified protein sequence (wt) from HRSV__AFM55211.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9113 - protein, 553 aa, synthetic construct
  REGION 1..553: note = derived and/or modified protein sequence (wt) from HRSV__AFI25262.1__F-del
MELLIHRSSAIFLTLAINALYLTSSQNITEEFYQSTCSAVSRGYFSALRTGWYTSVITIELSNIKEIKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDSSISQVNEKINQSLAFIRRSDELLHNVNTGKSTTNIMITAIIIVIIVVLLSLIAIGLLLYCKAK

SEQ ID NO: 9114 - protein, 553 aa, synthetic construct
  REGION 1..553: note = derived and/or modified protein sequence (wt) from HRSV__AFD34266.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9115 - protein, 553 aa, synthetic construct
  REGION 1..553: note = derived and/or modified protein sequence (wt) from HRSV__AFM55332.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9116 - protein, 553 aa, synthetic construct
  REGION 1..553: note = derived and/or modified protein sequence (wt) from HRSV__AFD34264.1__F-del
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNGELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9117 - protein, 553 aa, synthetic construct
  REGION 1..553: note = derived and/or modified protein sequence (wt) from HRSV__AFD34262.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTHMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9118 - protein, 553 aa, synthetic construct
  REGION 1..553: note = derived and/or modified protein sequence (wt) from HRSV__AFD34265.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREASQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9119 - protein, 553 aa, synthetic construct
  REGION 1..553: note = derived and/or modified protein sequence (wt) from HRSV__AFD34261.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFGVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9120 - protein, 553 aa, synthetic construct
  REGION 1..553: note = derived and/or modified protein sequence (wt) from HRSV__AFD34260.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9121 - protein, 553 aa, synthetic construct
  REGION 1..553: note = derived and/or modified protein sequence (wt) from HRSV__AFD34259.1__F-del
MELLIYRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9122 - protein, 553 aa, synthetic construct
  REGION 1..553: note = derived and/or modified protein sequence (wt) from HRSV__AEQ63641.1__F-del
MELLIHRSSAIFLTLAINAFYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9123 - protein, 553 aa, synthetic construct
  REGION 1..553: note = derived and/or modified protein sequence (wt) from HRSV__AEQ63487.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9124 - protein, 553 aa, synthetic construct
  REGION 1..553: note = derived and/or modified protein sequence (wt) from HRSV__AEQ63520.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9125 - protein, 553 aa, synthetic construct
  REGION 1..553: note = derived and/or modified protein sequence (wt) from HRSV__4CCF_A__F-del
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQVLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9126 - protein, 553 aa, synthetic construct
  REGION 1..553: note = derived and/or modified protein sequence (wt) from HRSV__AEQ63334.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9127 - protein, 553 aa, synthetic construct
  REGION 1..553: note = derived and/or modified protein sequence (wt) from HRSV__AEO45949.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKAR

SEQ ID NO: 9128 - protein, 553 aa, synthetic construct
  REGION 1..553: note = derived and/or modified protein sequence (wt) from HRSV__AEO45939.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSFIDGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKAR

SEQ ID NO: 9129 - protein, 553 aa, synthetic construct
  REGION 1..553: note = derived and/or modified protein sequence (wt) from HRSV__AEQ63312.1__F-del
MELPVLKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9130 - protein, 553 aa, synthetic construct
  REGION 1..553: note = derived and/or modified protein sequence (wt) from HRSV__AEQ63586.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9131 - protein, 553 aa, synthetic construct
  REGION 1..553: note = derived and/or modified protein sequence (wt) from HRSV__AEO45919.1__F-del
MELPILKINAITTILAAITLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKAR

SEQ ID NO: 9132 - protein, 553 aa, synthetic construct
  REGION 1..553: note = derived and/or modified protein sequence (wt) from HRSV__AEO45909.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKAR

SEQ ID NO: 9133 - protein, 553 aa, synthetic construct
  REGION 1..553: note = derived and/or modified protein sequence (wt) from HRSV__AEO45889.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9134 - protein, 553 aa, synthetic construct
  REGION 1..553: note = derived and/or modified protein sequence (wt) from HRSV__AEO45879.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9135 - protein, 553 aa, synthetic construct
  REGION 1..553: note = derived and/or modified protein sequence (wt) from HRSV__AEO45869.1__F-del
MELPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKAR

SEQ ID NO: 9136 - protein, 553 aa, synthetic construct
  REGION 1..553: note = derived and/or modified protein sequence (wt) from HRSV__AEO45929.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9137 - protein, 553 aa, synthetic construct
  REGION 1..553: note = derived and/or modified protein sequence (wt) from HRSV__AEO45850.1__F-del
MELPILKTNAITTILTAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKAR

SEQ ID NO: 9138 - protein, 553 aa, synthetic construct
  REGION 1..553: note = derived and/or modified protein sequence (wt) from HRSV__AEO45859.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9139 - protein, 553 aa, synthetic construct
  REGION 1..553: note = derived and/or modified protein sequence (wt) from HRSV__AEQ63444.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9140 - protein, 553 aa, synthetic construct
  REGION 1..553: note = derived and/or modified protein sequence (wt) from HRSV__AEO23054.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSTSKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9141 - protein, 553 aa, synthetic construct
  REGION 1..553: note = derived and/or modified protein sequence (wt) from HRSV__AEO23052.1__F-del
MELPILKANAISTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9142 - protein, 553 aa, synthetic construct
  REGION 1..553: note = derived and/or modified protein sequence (wt) from HRSV__AEO23051.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9143 - protein, 553 aa, synthetic construct
  REGION 1..553: note = derived and/or modified protein sequence (wt) from HRSV__AEC32087.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9144 - protein, 553 aa, synthetic construct
  REGION 1..553: note = derived and/or modified protein sequence (wt) from HRSV__ADZ95785.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKELMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9145 - protein, 553 aa, synthetic construct
  REGION 1..553: note = derived and/or modified protein sequence (wt) from HRSV__AEC32085.1__F-del
MELPILKTNAITTILAAVTLCFASSQNITEEFYQSTCSAVSKGYLSALRTGWYTSVITIELSTIKENKCNGTDAKGKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTKIMITTIIIVIIVILLSLIAVGLLLYCKAR

SEQ ID NO: 9146 - protein, 553 aa, synthetic construct
  REGION 1..553: note = derived and/or modified protein sequence (wt) from HRSV__ADZ95784.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKQLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9147 - protein, 553 aa, synthetic construct
  REGION 1..553: note = derived and/or modified protein sequence (wt) from HRSV__ADZ95783.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKTLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9148 - protein, 553 aa, synthetic construct
  REGION 1..553: note = derived and/or modified protein sequence (wt) from HRSV__ADZ95782.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKMLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9149 - protein, 553 aa, synthetic construct
  REGION 1..553: note = derived and/or modified protein sequence (wt) from HRSV__ADZ95781.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKNLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9150 - protein, 553 aa, synthetic construct
  REGION 1..553: note = derived and/or modified protein sequence (wt) from HRSV__ADZ95779.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMLSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9151 - protein, 553 aa, synthetic construct
  REGION 1..553: note = derived and/or modified protein sequence (wt) from HRSV__ADZ95778.1__F-del
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMFNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9152 - protein, 553 aa, synthetic construct
  REGION 1..553: note = derived and/or modified protein sequence (wt) from HRSV__ADZ95775.1__F-del
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAVNNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKELMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9153 - protein, 553 aa, synthetic construct
  REGION 1..553: note = derived and/or modified protein sequence (wt) from HRSV__ACY68435.1__F-del
MELPILKTNAITTILAAVTLCFASSQNITEEFYQSTCSAVSKGYLSALRTGWYTSVITIELSTIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9154 - protein, 553 aa, synthetic construct
  REGION 1..553: note = derived and/or modified protein sequence (wt) from HRSV__ACO83302.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9155 - protein, 553 aa, synthetic construct
  REGION 1..553: note = derived and/or modified protein sequence (wt) from HRSV__ABI35685.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKADVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9156 - protein, 553 aa, synthetic construct
  REGION 1..553: note = derived and/or modified protein sequence (wt) from HRSV__AFI25251.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9157 - protein, 553 aa, synthetic construct
  REGION 1..553: note = derived and/or modified protein sequence (wt) from HRSV__AAX23994.1__F-del
MELPILKANAITTILAAVTFCFASSQNITEEFYQSTCSAVSKGYLSALRTGWYTSVITIELSNIKENKCNGTDAKVKLINQELDKYKNAVTELQLLMQSTTAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9158 - protein, 553 aa, synthetic construct
  REGION 1..553: note = derived and/or modified protein sequence (wt) from HRSV__AAQ97026.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYGCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9159 - protein, 553 aa, synthetic construct
  REGION 1..553: note = derived and/or modified protein sequence (wt) from HRSV__AAR14266.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLTQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKSYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9160 - protein, 553 aa, synthetic construct
  REGION 1..553: note = derived and/or modified protein sequence (wt) from HRSV__AAQ97027.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCRIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9161 - protein, 553 aa, synthetic construct
  REGION 1..553: note = derived and/or modified protein sequence (wt) from HRSV__AAQ97030.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGAGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9162 - protein, 553 aa, synthetic construct
  REGION 1..553: note = derived and/or modified protein sequence (wt) from HRSV__AAQ97028.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFEASISQVNEKINQSLAFIRKSDELLHHVNAGKSTTNIMITTIIIVIIVILLSLIAVGLLLYCKAR

SEQ ID NO: 9163 - protein, 553 aa, synthetic construct
  REGION 1..553: note = derived and/or modified protein sequence (wt) from HRSV__AAC57027.1__F-del
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9164 - protein, 553 aa, synthetic construct
  REGION 1..553: note = derived and/or modified protein sequence (wt) from HRSV__AAQ97029.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGLLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9165 - protein, 553 aa, synthetic construct
  REGION 1..553: note = derived and/or modified protein sequence (wt) from HRSV__AAQ97031.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9166 - protein, 553 aa, synthetic construct
  REGION 1..553: note = derived and/or modified protein sequence (wt) from HRSV__AAM68160.1__F-del
MDLPILKTNAITTILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9167 - protein, 553 aa, synthetic construct
  REGION 1..553: note = derived and/or modified protein sequence (wt) from HRSV__AAM44851.1__F-del
MELPILKANAITTILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9168 - protein, 553 aa, synthetic construct
  REGION 1..553: note = derived and/or modified protein sequence (wt) from HRSV__P11209.2__F-del
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKDRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9169 - protein, 553 aa, synthetic construct
  REGION 1..553: note = derived and/or modified protein sequence (wt) from HRSV__P13843.1__F-del
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9170 - protein, 553 aa, synthetic construct
  REGION 1..553: note = derived and/or modified protein sequence (wt) from HRSV__AAO72325.1__F-del
MELPILKTNAITTILAAVTLCFASSQNITEEFYQSTCSAVSKGYLSALRTGWYTSVITIELSNIKENKCNGTDAKAKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLHLKNYIDKQFLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKAR

SEQ ID NO: 9171 - protein, 553 aa, synthetic construct
  REGION 1..553: note = derived and/or modified protein sequence (wt) from HRSV__AAM68157.1__F-del
MDLPILKTNAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9172 - protein, 553 aa, synthetic construct
  REGION 1..553: note = derived and/or modified protein sequence (wt) from HRSV__CAA26143.1__F-del
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9173 - protein, 553 aa, synthetic construct
  REGION 1..553: note = derived and/or modified protein sequence (wt) from HRSV__1512372A__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVDKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9174 - protein, 553 aa, synthetic construct
  REGION 1..553: note = derived and/or modified protein sequence (wt) from HRSV__AAB86664.1__F-del
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKAR

SEQ ID NO: 9175 - protein, 553 aa, synthetic construct
  REGION 1..553: note = derived and/or modified protein sequence (wt) from HRSV__AAO72324.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPFDEFDASISQVNEKINQSLAFIRKSDELLHNVNAGKSTINIMITTIIIVIIVILLSLIAVGLLLYCKAR

SEQ ID NO: 9176 - protein, 553 aa, synthetic construct
  REGION 1..553: note = derived and/or modified protein sequence (wt) from HRSV__AAB82446.1__F-del
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIGTVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9177 - protein, 553 aa, synthetic construct
  REGION 1..553: note = derived and/or modified protein sequence (wt) from HRSV__AAO72323.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKAR

SEQ ID NO: 9178 - protein, 553 aa, synthetic construct
  REGION 1..553: note = derived and/or modified protein sequence (wt) from HRSV__AAM68154.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSISFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLCVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9179 - protein, 553 aa, synthetic construct
  REGION 1..553: note = derived and/or modified protein sequence (wt) from HRSV__AAA47410.1__F-del
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9180 - protein, 553 aa, synthetic construct
  REGION 1..553: note = derived and/or modified protein sequence (wt) from HRSV__P12568.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9181 - protein, 553 aa, synthetic construct
  REGION 1..553: note = derived and/or modified protein sequence (wt) from HRSV__ARB07894.1__F-del
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMYSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9182 - protein, 553 aa, synthetic construct
  REGION 1..553: note = derived and/or modified protein sequence (wt) from HRSV__AGG39517.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9183 - protein, 553 aa, synthetic construct
  REGION 1..553: note = derived and/or modified protein sequence (wt) from HRSV__BBC54612.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKIQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9184 - protein, 553 aa, synthetic construct
  REGION 1..553: note = derived and/or modified protein sequence (wt) from HRSV__BBC54636.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRLMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9185 - protein, 553 aa, synthetic construct
  REGION 1..553: note = derived and/or modified protein sequence (wt) from HRSV__BBC54627.1__F-del
MELPILKTNAITTILAAVTLCFASSQNITEEFYQSTCSAVSKGYLSALRTGWYTGVITIELSNIKENKCNGTDAKVKLIKQELDKYKNAVTELQLLMQSTPAANSRARRELPRFMNYTLNNTKSTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9186 - protein, 553 aa, synthetic construct
  REGION 1..553: note = derived and/or modified protein sequence (wt) from HRSV__BBC54621.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQTNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9187 - protein, 553 aa, synthetic construct
  REGION 1..553: note = derived and/or modified protein sequence (wt) from HRSV__BBC54570.1__F-del
MELPILKTNAITTILASVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9188 - protein, 553 aa, synthetic construct
  REGION 1..553: note = derived and/or modified protein sequence (wt) from HRSV__BBC54579.1__F-del
MELPIFKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9189 - protein, 553 aa, synthetic construct
  REGION 1..553: note = derived and/or modified protein sequence (wt) from HRSV__BBC54595.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIVVGLLLYCKAR

SEQ ID NO: 9190 - protein, 553 aa, synthetic construct
  REGION 1..553: note = derived and/or modified protein sequence (wt) from HRSV__BBC54555.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLGKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINLYDPLVFPSDEFDASISQVNEKINQSLAFIRKSDELLHNVNAGKSTTNIMITTIIIVIIVILLALIAVGLLLYCKAR

SEQ ID NO: 9191 - protein, 553 aa, synthetic construct
  REGION 1..553: note = derived and/or modified protein sequence (wt) from HRSV__BBC54552.1__F-del
MELPILKTNAITTILAAVALCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9192 - protein, 553 aa, synthetic construct
  REGION 1..553: note = derived and/or modified protein sequence (wt) from HRSV__BBC54564.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSIRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9193 - protein, 553 aa, synthetic construct
  REGION 1..553: note = derived and/or modified protein sequence (wt) from HRSV__BBC54581.1__F-del
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTSVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9194 - protein, 553 aa, synthetic construct
  REGION 1..553: note = derived and/or modified protein sequence (wt) from HRSV__BBC54571.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRLMNYTLKNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9195 - protein, 553 aa, synthetic construct
  REGION 1..553: note = derived and/or modified protein sequence (wt) from HRSV__BBC54553.1__F-del
MELLILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIIILLALIAVGLLLYCKAR

SEQ ID NO: 9196 - protein, 553 aa, synthetic construct
  REGION 1..553: note = derived and/or modified protein sequence (wt) from HRSV__BBC54565.1__F-del
MELPILKTNAITTILAAVTLCFASSQNITEEFYQSTCSAVSKGYLSALRTGWYTSVITIELSNIKENKCNGTDAKVKLIKQELDKYKNAVTELQMLMQSTPAANSRARRELPRFMNYTLNNTKNTNVTLSKKRKRRFLGFLLGVGSAIASGIAVSKVLHLEGEVNKIKSALLSTNKAAVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9197 - protein, 553 aa, synthetic construct
  REGION 1..553: note = derived and/or modified protein sequence (wt) from HRSV__BBC54245.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLQLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIIQPTIIIVIIVILLALIAVGLLLYCKAR

SEQ ID NO: 9198 - protein, 553 aa, synthetic construct
  REGION 1..553: note = derived and/or modified protein sequence (wt) from HRSV__BBC54243.1__F-del
MELPILKTNAITTILAAVTLCFASGQNITEEFYQSTCSAVSKGYLSALRTGWYTSVITIELSNIKENKCNGTDAKVKLIKQELDKYKNAVTELQLLMQSTPAASSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9199 - protein, 553 aa, synthetic construct
  REGION 1..553: note = derived and/or modified protein sequence (wt) from HRSV__BBC54238.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKKEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9200 - protein, 553 aa, synthetic construct
  REGION 1..553: note = derived and/or modified protein sequence (wt) from HRSV__BBC54242.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQINEKINQSLAFIRKSDELLHNVNAGKSTTNIMITTIIIVIIVILLALIAVGLLLYCKAR

SEQ ID NO: 9201 - protein, 553 aa, synthetic construct
  REGION 1..553: note = derived and/or modified protein sequence (wt) from HRSV__BBC54239.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEYQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9202 - protein, 553 aa, synthetic construct
  REGION 1..553: note = derived and/or modified protein sequence (wt) from HRSV__BBC54235.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPVANSRARRELPRFMNYTLNDTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9203 - protein, 553 aa, synthetic construct
  REGION 1..553: note = derived and/or modified protein sequence (wt) from HRSV__BBC54234.1__F-del
MELPILKTNAITTILAAVTFCFAFSQNITEEFYQSTCSAVSKGYLSALRTGWYTSVITIELSNIKENKCNGTDAKVKLIKQDLDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9204 - protein, 553 aa, synthetic construct
  REGION 1..553: note = derived and/or modified protein sequence (wt) from HRSV__BBC54236.1__F-del
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKAR

SEQ ID NO: 9205 - protein, 553 aa, synthetic construct
  REGION 1..553: note = derived and/or modified protein sequence (wt) from HRSV__BBC54244.1__F-del
MELPILKTNAITTILAAVTLCFASSQNITEEFYQSTCSAVSKGYLSALRTGWYTSVITIELSNIKENKCNGTDAKVKLIKQELDKYKNAVTEVQLLMQSTPADNSRARKEQPRFIDYTLNNTKNTNVTLSKKRKRRFLGFLLGVGSAIASGIAVSKVMHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9206 - protein, 553 aa, synthetic construct
  REGION 1..553: note = derived and/or modified protein sequence (wt) from HRSV__BBC54186.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIREEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9207 - protein, 553 aa, synthetic construct
  REGION 1..553: note = derived and/or modified protein sequence (wt) from HRSV__BBC54178.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKDTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9208 - protein, 553 aa, synthetic construct
  REGION 1..553: note = derived and/or modified protein sequence (wt) from HRSV__BBC54202.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLHYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9209 - protein, 553 aa, synthetic construct
  REGION 1..553: note = derived and/or modified protein sequence (wt) from HRSV__BBC54151.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPVVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9210 - protein, 553 aa, synthetic construct
  REGION 1..553: note = derived and/or modified protein sequence (wt) from HRSV__BBC54142.1__F-del
MELPILKTNAITTILAAITLCFASSQNITEEFFQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9211 - protein, 553 aa, synthetic construct
  REGION 1..553: note = derived and/or modified protein sequence (wt) from HRSV__BBC54134.1__F-del
MDLPILKTNAITTILAAVTLCFTSSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9212 - protein, 553 aa, synthetic construct
  REGION 1..553: note = derived and/or modified protein sequence (wt) from HRSV__BBC54170.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKAR

SEQ ID NO: 9213 - protein, 553 aa, synthetic construct
  REGION 1..553: note = derived and/or modified protein sequence (wt) from HRSV__BBC54210.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPVANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9214 - protein, 553 aa, synthetic construct
  REGION 1..553: note = derived and/or modified protein sequence (wt) from HRSV__BBC54169.1__F-del
MELPILKTNAITTILAVVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9215 - protein, 553 aa, synthetic construct
  REGION 1..553: note = derived and/or modified protein sequence (wt) from HRSV__BBC54213.1__F-del
MELPILKTNAITTILAAVTFCFAFSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9216 - protein, 553 aa, synthetic construct
  REGION 1..553: note = derived and/or modified protein sequence (wt) from HRSV__BBC54203.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9217 - protein, 553 aa, synthetic construct
  REGION 1..553: note = derived and/or modified protein sequence (wt) from HRSV__BBC54160.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNASKSTTNIMITTIIIVIIVILLALIAVGLLLYCKAR

SEQ ID NO: 9218 - protein, 553 aa, synthetic construct
  REGION 1..553: note = derived and/or modified protein sequence (wt) from HRSV__BBC54163.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKVVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKAR

SEQ ID NO: 9219 - protein, 553 aa, synthetic construct
  REGION 1..553: note = derived and/or modified protein sequence (wt) from HRSV__BBC54215.1__F-del
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAIGLLLYCKAR

SEQ ID NO: 9220 - protein, 553 aa, synthetic construct
  REGION 1..553: note = derived and/or modified protein sequence (wt) from HRSV__BBC54156.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPVTNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9221 - protein, 553 aa, synthetic construct
  REGION 1..553: note = derived and/or modified protein sequence (wt) from HRSV__BBC54179.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQLNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKGR

SEQ ID NO: 9222 - protein, 553 aa, synthetic construct
  REGION 1..553: note = derived and/or modified protein sequence (wt) from HRSV__BBC54150.1__F-del
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9223 - protein, 553 aa, synthetic construct
  REGION 1..553: note = derived and/or modified protein sequence (wt) from HRSV__BBC54207.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLDNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9224 - protein, 553 aa, synthetic construct
  REGION 1..553: note = derived and/or modified protein sequence (wt) from HRSV__BBC54194.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMYYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9225 - protein, 553 aa, synthetic construct
  REGION 1..553: note = derived and/or modified protein sequence (wt) from HRSV__BBC54149.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNHKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9226 - protein, 553 aa, synthetic construct
  REGION 1..553: note = derived and/or modified protein sequence (wt) from HRSV__BBC54138.1__F-del
MDLPILKTNAITTILAAVTLCFASSQNITEEFYQSTCSAISKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9227 - protein, 553 aa, synthetic construct
  REGION 1..553: note = derived and/or modified protein sequence (wt) from HRSV__BBC54199.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSATASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGETKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKAR

SEQ ID NO: 9228 - protein, 553 aa, synthetic construct
  REGION 1..553: note = derived and/or modified protein sequence (wt) from HRSV__BBC54220.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNVMITTIIIVIIVILLALIAVGLLLYCKAR

SEQ ID NO: 9229 - protein, 553 aa, synthetic construct
  REGION 1..553: note = derived and/or modified protein sequence (wt) from HRSV__BBC54181.1__F-del
MELPIIKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9230 - protein, 553 aa, synthetic construct
  REGION 1..553: note = derived and/or modified protein sequence (wt) from HRSV__BBC54132.1__F-del
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKIKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9231 - protein, 553 aa, synthetic construct
  REGION 1..553: note = derived and/or modified protein sequence (wt) from HRSV__BBC54146.1__F-del
MELPILKTNAITTILATVTLCFASSQNITEEFYQSTCSAVSKGYLSALRTGWYTSVITIELSNIKKNKCNGTDAKVKLIKQELDKYKNAVTELQLLMQSTPAANSRARRELPRFINYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9232 - protein, 553 aa, synthetic construct
  REGION 1..553: note = derived and/or modified protein sequence (wt) from HRSV__BBC54122.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLIFPSDEFDASISQVNEKINQSLAFIRKSDELLHNINAGKSTTNIMITTIIIVIVVILLSLIAVGLLLYCKAR

SEQ ID NO: 9233 - protein, 553 aa, synthetic construct
  REGION 1..553: note = derived and/or modified protein sequence (wt) from HRSV__BBC54124.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSSTNIMITTIIIVIVVILLSLIAVGLLLYCKAR

SEQ ID NO: 9234 - protein, 553 aa, synthetic construct
  REGION 1..553: note = derived and/or modified protein sequence (wt) from HRSV__BBB35202.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9235 - protein, 553 aa, synthetic construct
  REGION 1..553: note = derived and/or modified protein sequence (wt) from HRSV__BBB35201.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLSFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9236 - protein, 553 aa, synthetic construct
  REGION 1..553: note = derived and/or modified protein sequence (wt) from HRSV__BBB35192.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLYNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9237 - protein, 553 aa, synthetic construct
  REGION 1..553: note = derived and/or modified protein sequence (wt) from HRSV__BBB35193.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFRNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9238 - protein, 553 aa, synthetic construct
  REGION 1..553: note = derived and/or modified protein sequence (wt) from HRSV__BBB35199.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSLSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9239 - protein, 553 aa, synthetic construct
  REGION 1..553: note = derived and/or modified protein sequence (wt) from HRSV__BBB35184.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9240 - protein, 553 aa, synthetic construct
  REGION 1..553: note = derived and/or modified protein sequence (wt) from HRSV__BBB35126.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQLNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9241 - protein, 553 aa, synthetic construct
  REGION 1..553: note = derived and/or modified protein sequence (wt) from HRSV__BBB35133.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQSETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9242 - protein, 553 aa, synthetic construct
  REGION 1..553: note = derived and/or modified protein sequence (wt) from HRSV__BBB35130.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9243 - protein, 553 aa, synthetic construct
  REGION 1..553: note = derived and/or modified protein sequence (wt) from HRSV__BBB35160.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFTNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIVVGLLLYCKAR

SEQ ID NO: 9244 - protein, 553 aa, synthetic construct
  REGION 1..553: note = derived and/or modified protein sequence (wt) from HRSV__BBB35162.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLTTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLTFIRKSDELLHNVNVGKSTTNIMITTIIIVIIVILLLLIAVGLFLYCKAR

SEQ ID NO: 9245 - protein, 553 aa, synthetic construct
  REGION 1..553: note = derived and/or modified protein sequence (wt) from HRSV__BBB35181.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNTRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSITNIMITTIIIVIIVILLSLIAVGLLLYCKAR

SEQ ID NO: 9246 - protein, 553 aa, synthetic construct
  REGION 1..553: note = derived and/or modified protein sequence (wt) from HRSV__BBB35165.1__F-del
MDLPILKTNAITAIFAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9247 - protein, 553 aa, synthetic construct
  REGION 1..553: note = derived and/or modified protein sequence (wt) from HRSV__BBB35121.1__F-del
MELPILKTNAITTILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9248 - protein, 553 aa, synthetic construct
  REGION 1..553: note = derived and/or modified protein sequence (wt) from HRSV__BBB35138.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9249 - protein, 553 aa, synthetic construct
  REGION 1..553: note = derived and/or modified protein sequence (wt) from HRSV__BBB35176.1__F-del
MDLPILKTNAITAILAAVSLCFASSQNITEEFYQSTCSAVSKGYLSALRTGWYTSVITIELSNIKENKCNGTDTKVKLIKQELDKYKNAVTELQLLMQSTPAANNRARRELPRFMNHTLNNTKDNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9250 - protein, 553 aa, synthetic construct
  REGION 1..553: note = derived and/or modified protein sequence (wt) from HRSV__BBB35142.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKNTNVTVSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9251 - protein, 553 aa, synthetic construct
  REGION 1..553: note = derived and/or modified protein sequence (wt) from HRSV__BBB35136.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9252 - protein, 553 aa, synthetic construct
  REGION 1..553: note = derived and/or modified protein sequence (wt) from HRSV__BBB35153.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGITKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9253 - protein, 553 aa, synthetic construct
  REGION 1..553: note = derived and/or modified protein sequence (wt) from HRSV__BBB35115.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9254 - protein, 553 aa, synthetic construct
  REGION 1..553: note = derived and/or modified protein sequence (wt) from HRSV__BBB35150.1__F-del
MDLPILKTNAITTILATVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9255 - protein, 553 aa, synthetic construct
  REGION 1..553: note = derived and/or modified protein sequence (wt) from HRSV__BBB35097.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9256 - protein, 553 aa, synthetic construct
  REGION 1..553: note = derived and/or modified protein sequence (wt) from HRSV__BBB35109.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGMLLYCKAR

SEQ ID NO: 9257 - protein, 553 aa, synthetic construct
  REGION 1..553: note = derived and/or modified protein sequence (wt) from HRSV__BBB35094.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQLNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9258 - protein, 553 aa, synthetic construct
  REGION 1..553: note = derived and/or modified protein sequence (wt) from HRSV__BBB35183.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNTRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKVMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9259 - protein, 553 aa, synthetic construct
  REGION 1..553: note = derived and/or modified protein sequence (wt) from HRSV__BBB35104.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGMLLYCKAR

SEQ ID NO: 9260 - protein, 553 aa, synthetic construct
  REGION 1..553: note = derived and/or modified protein sequence (wt) from HRSV__BBB35099.1__F-del
MELPILKTNAITTILAAVTLCFASSQNITEEFYQSTCSAVSKGYLSALRTGWYTSVITIELSNIKENKCNGTDSKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9261 - protein, 553 aa, synthetic construct
  REGION 1..553: note = derived and/or modified protein sequence (wt) from HRSV__BBB35188.1__F-del
MDLPILKTNAITAILAAVSLYFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNSKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9262 - protein, 553 aa, synthetic construct
  REGION 1..553: note = derived and/or modified protein sequence (wt) from HRSV__AKA45871.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9263 - protein, 553 aa, synthetic construct
  REGION 1..553: note = derived and/or modified protein sequence (wt) from HRSV__ASV65838.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9264 - protein, 553 aa, synthetic construct
  REGION 1..553: note = derived and/or modified protein sequence (wt) from HRSV__AGG39373.1__F-del
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9265 - protein, 553 aa, synthetic construct
  REGION 1..553: note = derived and/or modified protein sequence (wt) from HRSV__AII22107.1__F-del
MELLILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9266 - protein, 553 aa, synthetic construct
  REGION 1..553: note = derived and/or modified protein sequence (wt) from HRSV__AGG39400.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9267 - protein, 553 aa, synthetic construct
  REGION 1..553: note = derived and/or modified protein sequence (wt) from HRSV__AGG39457.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9268 - protein, 553 aa, synthetic construct
  REGION 1..553: note = derived and/or modified protein sequence (wt) from HRSV__ARR29240.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYIINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9269 - protein, 553 aa, synthetic construct
  REGION 1..553: note = derived and/or modified protein sequence (wt) from HRSV__ARR29251.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFVNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9270 - protein, 553 aa, synthetic construct
  REGION 1..553: note = derived and/or modified protein sequence (wt) from HRSV__ARR29189.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLDNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9271 - protein, 553 aa, synthetic construct
  REGION 1..553: note = derived and/or modified protein sequence (wt) from HRSV__ARR29207.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNEQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9272 - protein, 553 aa, synthetic construct
  REGION 1..553: note = derived and/or modified protein sequence (wt) from HRSV__AUH15164.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGETKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9273 - protein, 553 aa, synthetic construct
  REGION 1..553: note = derived and/or modified protein sequence (wt) from HRSV__ATV81343.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9274 - protein, 553 aa, synthetic construct
  REGION 1..553: note = derived and/or modified protein sequence (wt) from HRSV__AUC68654.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLFLYCKAR

SEQ ID NO: 9275 - protein, 553 aa, synthetic construct
  REGION 1..553: note = derived and/or modified protein sequence (wt) from HRSV__AUC68577.1__F-del
MELMIHKSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQYMNYTVNTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGDPIINYYDPLVFPSDEFDASISQVNEKINQSLAFIRRSDELLHNVNTGKSTTNIMITTIIIVIIVVLLSLIAIGLLLYCKAK

SEQ ID NO: 9276 - protein, 553 aa, synthetic construct
  REGION 1..553: note = derived and/or modified protein sequence (wt) from HRSV__AUC68566.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSNELLHNVNAGKSTTNIMITTIIIVIIVILLSLIAVGLLLYCKAR

SEQ ID NO: 9277 - protein, 553 aa, synthetic construct
  REGION 1..553: note = derived and/or modified protein sequence (wt) from HRSV__AUC68555.1__F-del
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9278 - protein, 553 aa, synthetic construct
  REGION 1..553: note = derived and/or modified protein sequence (wt) from HRSV__AUC68478.1__F-del
MELLIHRSSAIFLTLAINALYLTSSQNITEEFYQSTCSAVSRGYFSALRTGWYTSVITIELSNIKETKCNGTDTKAKLIKQELDKYKNAVTELQLLMQNTPAANNRARREAPQYMNYTVNTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9279 - protein, 553 aa, synthetic construct
  REGION 1..553: note = derived and/or modified protein sequence (wt) from HRSV__AUC68445.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMSYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIVVGLLLYCKAR

SEQ ID NO: 9280 - protein, 553 aa, synthetic construct
  REGION 1..553: note = derived and/or modified protein sequence (wt) from HRSV__AUC68500.1__F-del
MELMIHKSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9281 - protein, 553 aa, synthetic construct
  REGION 1..553: note = derived and/or modified protein sequence (wt) from HRSV__AUC68522.1__F-del
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTHCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9282 - protein, 553 aa, synthetic construct
  REGION 1..553: note = derived and/or modified protein sequence (wt) from HRSV__AUC68291.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTITIVITVILLLLIAVGLFLYCKAR

SEQ ID NO: 9283 - protein, 553 aa, synthetic construct
  REGION 1..553: note = derived and/or modified protein sequence (wt) from HRSV__AUC68149.1__F-del
MELPILKTNAITTILAAVTLCFASSQNITEEFYQSTCSAVSKGYFSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9284 - protein, 553 aa, synthetic construct
  REGION 1..553: note = derived and/or modified protein sequence (wt) from HRSV__AUC68094.1__F-del
MELPILKTNAITTILAAVTLCFASSQNITEEFYQATCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVPHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9285 - protein, 553 aa, synthetic construct
  REGION 1..553: note = derived and/or modified protein sequence (wt) from HRSV__AMA67097.1__F-del
MELLIHRSSAVFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCRAK

SEQ ID NO: 9286 - protein, 553 aa, synthetic construct
  REGION 1..553: note = derived and/or modified protein sequence (wt) from HRSV__AMA66866.1__F-del
MELPILKTNAITTILATVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9287 - protein, 553 aa, synthetic construct
  REGION 1..553: note = derived and/or modified protein sequence (wt) from HRSV__AMA66580.1__F-del
MELPILKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9288 - protein, 553 aa, synthetic construct
  REGION 1..553: note = derived and/or modified protein sequence (wt) from HRSV__AIZ95750.1__F-del
MELLIHRSSAIFLTIAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9289 - protein, 553 aa, synthetic construct
  REGION 1..553: note = derived and/or modified protein sequence (wt) from HRSV__AIZ95541.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLLLIAVGLFLYCKAR

SEQ ID NO: 9290 - protein, 553 aa, synthetic construct
  REGION 1..553: note = derived and/or modified protein sequence (wt) from HRSV__AIZ95519.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9291 - protein, 553 aa, synthetic construct
  REGION 1..553: note = derived and/or modified protein sequence (wt) from HRSV__AHY21419.1__F-del
MELPILKTNAITTILAAVTLCFASSQNITEEFYQATCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9292 - protein, 553 aa, synthetic construct
  REGION 1..553: note = derived and/or modified protein sequence (wt) from HRSV__AHY21331.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9293 - protein, 553 aa, synthetic construct
  REGION 1..553: note = derived and/or modified protein sequence (wt) from HRSV__AHY21165.1__F-del
MELMIHKSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGDPIINYYDPLVFPSDEFDASISQVNEKINQSLAFIRRSDELLHNVNTGKSTTNIMITTIIIVIIVVLLSLIAIGLLLYCKAK

SEQ ID NO: 9294 - protein, 553 aa, synthetic construct
  REGION 1..553: note = derived and/or modified protein sequence (wt) from HRSV__AHY21143.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9295 - protein, 553 aa, synthetic construct
  REGION 1..553: note = derived and/or modified protein sequence (wt) from HRSV__AHY21132.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9296 - protein, 553 aa, synthetic construct
  REGION 1..553: note = derived and/or modified protein sequence (wt) from HRSV__AGG39478.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9297 - protein, 553 aa, synthetic construct
  REGION 1..553: note = derived and/or modified protein sequence (wt) from HRSV__ATV93506.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNATLSKKRKRRFLGFLLGVGSAIASGIAVSKVLHLEGEVNKIKSALLSTNKAVVSLSNGVSVLTSKVLDLKNYIDKQLLPIVNKQSCSISNIETVMEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9298 - protein, 553 aa, synthetic construct
  REGION 1..553: note = derived and/or modified protein sequence (wt) from HRSV__ATV93509.1__F-del
MELPILKTNAITTILAAVILCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9299 - protein, 553 aa, synthetic construct
  REGION 1..553: note = derived and/or modified protein sequence (wt) from HRSV__AIZ95717.1__F-del
MELPTIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRVMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9300 - protein, 553 aa, synthetic construct
  REGION 1..553: note = derived and/or modified protein sequence (wt) from HRSV__ATV81354.1__F-del
MDLPILKTNAITTILATVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9301 - protein, 553 aa, synthetic construct
  REGION 1..553: note = derived and/or modified protein sequence (wt) from HRSV__ART28317.1__F-del
MELPILKTNAITTIFAAVTLCFASSQNITEEFYQSTCSAVSKGYLSALRTGWYTSVITIELSNIKENKCNGTDTKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIGTVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPKAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9302 - protein, 553 aa, synthetic construct
  REGION 1..553: note = derived and/or modified protein sequence (wt) from HRSV__BBA57901.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSRVLDLKNYINNQLLPMVNRQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9303 - protein, 553 aa, synthetic construct
  REGION 1..553: note = derived and/or modified protein sequence (wt) from HRSV__ASZ70099.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNNKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9304 - protein, 553 aa, synthetic construct
  REGION 1..553: note = derived and/or modified protein sequence (wt) from HRSV__ART28361.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVIVLALIAVGLLLYCKAR

SEQ ID NO: 9305 - protein, 553 aa, synthetic construct
  REGION 1..553: note = derived and/or modified protein sequence (wt) from HRSV__AQX36844.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKAQSNRVFNNTITSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9306 - protein, 553 aa, synthetic construct
  REGION 1..553: note = derived and/or modified protein sequence (wt) from HRSV__ASK05520.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQHMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9307 - protein, 553 aa, synthetic construct
  REGION 1..553: note = derived and/or modified protein sequence (wt) from HRSV__ART28427.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLEFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9308 - protein, 553 aa, synthetic construct
  REGION 1..553: note = derived and/or modified protein sequence (wt) from HRSV__ART28297.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLSFIRKSDELLHNVNVGKSTTNIMITTIIIVIIVILLALIAVGLLLYCKAR

SEQ ID NO: 9309 - protein, 553 aa, synthetic construct
  REGION 1..553: note = derived and/or modified protein sequence (wt) from HRSV__ART28328.1__F-del
MDSPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9310 - protein, 553 aa, synthetic construct
  REGION 1..553: note = derived and/or modified protein sequence (wt) from HRSV__ARQ15966.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLYNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9311 - protein, 553 aa, synthetic construct
  REGION 1..553: note = derived and/or modified protein sequence (wt) from HRSV__ARN61507.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKGLYVKGEPIINFYDPLVFPSDEFDASISQVDEKINQSLAFLRKSDELLHNVNAGKSTTNIMITTIIIVIIVILLALIAVGLLLYCKAR

SEQ ID NO: 9312 - protein, 553 aa, synthetic construct
  REGION 1..553: note = derived and/or modified protein sequence (wt) from HRSV__ARA15413.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKSALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9313 - protein, 553 aa, synthetic construct
  REGION 1..553: note = derived and/or modified protein sequence (wt) from HRSV__AGG39394.1__F-del
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9314 - protein, 553 aa, synthetic construct
  REGION 1..553: note = derived and/or modified protein sequence (wt) from HRSV__APW78845.1__F-del
MELLIHRPSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNPNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9315 - protein, 553 aa, synthetic construct
  REGION 1..553: note = derived and/or modified protein sequence (wt) from HRSV__APW78867.1__F-del
MELLIHRSSAIFLTLAINALYLTSSQNITEEFYQSTCSAVSRGYLSALRTGWYTSVITIELSNIKETKCNGTDTKVKLIKQELDKYRNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9316 - protein, 553 aa, synthetic construct
  REGION 1..553: note = derived and/or modified protein sequence (wt) from HRSV__APW78900.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNCTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9317 - protein, 553 aa, synthetic construct
  REGION 1..553: note = derived and/or modified protein sequence (wt) from HRSV__APW78878.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTQAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9318 - protein, 553 aa, synthetic construct
  REGION 1..553: note = derived and/or modified protein sequence (wt) from HRSV__APW78779.1__F-del
MELLIYRSSAIFLTLAINALYLTSSQNITEEFYQSTCSAVSKGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9319 - protein, 553 aa, synthetic construct
  REGION 1..553: note = derived and/or modified protein sequence (wt) from HRSV__APW78702.1__F-del
MELLIHRSSAIFLTLAINALYLTSSQNITEEFYQSTCSAVSRGYLSALRSGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLLLIAIGLLLYCKAK

SEQ ID NO: 9320 - protein, 553 aa, synthetic construct
  REGION 1..553: note = derived and/or modified protein sequence (wt) from HRSV__APW78713.1__F-del
MELLIHRSSAIFLTLAIKALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9321 - protein, 553 aa, synthetic construct
  REGION 1..553: note = derived and/or modified protein sequence (wt) from HRSV__APW78680.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9322 - protein, 553 aa, synthetic construct
  REGION 1..553: note = derived and/or modified protein sequence (wt) from HRSV__APW78658.1__F-del
MELLIHRSSAIFLTLAINALYLTSSQNITEEFYQSTCSAVSRGYWSALRTGWYTSVITIELSNIKETKCNGTDTKVKLIKQELDKYKNAVTELQLLMQNTPAVNNRARREAPQYMDYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9323 - protein, 553 aa, synthetic construct
  REGION 1..553: note = derived and/or modified protein sequence (wt) from HRSV__APW78647.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAIASGIAVSKVLHLEGEVNKIKNALLSTNKAVVSLSNGVSVLTNKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9324 - protein, 553 aa, synthetic construct
  REGION 1..553: note = derived and/or modified protein sequence (wt) from HRSV__APW78636.1__F-del
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9325 - protein, 553 aa, synthetic construct
  REGION 1..553: note = derived and/or modified protein sequence (wt) from HRSV__AOS48870.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKSLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9326 - protein, 553 aa, synthetic construct
  REGION 1..553: note = derived and/or modified protein sequence (wt) from HRSV__APW78614.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLLLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9327 - protein, 553 aa, synthetic construct
  REGION 1..553: note = derived and/or modified protein sequence (wt) from HRSV__AMT78905.1__F-del
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9328 - protein, 553 aa, synthetic construct
  REGION 1..553: note = derived and/or modified protein sequence (wt) from HRSV__AMT77402.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSNNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9329 - protein, 553 aa, synthetic construct
  REGION 1..553: note = derived and/or modified protein sequence (wt) from HRSV__AOZ15479.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLASIAVGLLLYCKAR

SEQ ID NO: 9330 - protein, 553 aa, synthetic construct
  REGION 1..553: note = derived and/or modified protein sequence (wt) from HRSV__AGN28484.1__F-del
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9331 - protein, 553 aa, synthetic construct
  REGION 1..553: note = derived and/or modified protein sequence (wt) from HRSV__AHX57240.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNGELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLYNVNAGKSTTNIMITTIIIVIIVILLALIAIGLLLYCKAR

SEQ ID NO: 9332 - protein, 553 aa, synthetic construct
  REGION 1..553: note = derived and/or modified protein sequence (wt) from HRSV__AHX57031.1__F-del
MELPILKTNAITTILAAVTLCFASSQNITEEFYQSTCSAVSKGYLSALRTGWYTSVITIELSNIKENKCNGTDAKVKLIKQELDKYKNAITELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9333 - protein, 553 aa, synthetic construct
  REGION 1..553: note = derived and/or modified protein sequence (wt) from HRSV__AOS48980.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSINAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9334 - protein, 553 aa, synthetic construct
  REGION 1..553: note = derived and/or modified protein sequence (wt) from HRSV__AOS48848.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYYKAK

SEQ ID NO: 9335 - protein, 553 aa, synthetic construct
  REGION 1..553: note = derived and/or modified protein sequence (wt) from HRSV__AOS48815.1__F-del
MELPILKTNAIITILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9336 - protein, 553 aa, synthetic construct
  REGION 1..553: note = derived and/or modified protein sequence (wt) from HRSV__AOS48738.1__F-del
MELLIHRSSAIFLNLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQLTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9337 - protein, 553 aa, synthetic construct
  REGION 1..553: note = derived and/or modified protein sequence (wt) from HRSV__AOS49068.1__F-del
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMIIAIIIVIIVVLLSLIAIGLLLYCKAK

SEQ ID NO: 9338 - protein, 553 aa, synthetic construct
  REGION 1..553: note = derived and/or modified protein sequence (wt) from HRSV__AOS48727.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLIYCKAR

SEQ ID NO: 9339 - protein, 553 aa, synthetic construct
  REGION 1..553: note = derived and/or modified protein sequence (wt) from HRSV__AOS48716.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQSETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9340 - protein, 553 aa, synthetic construct
  REGION 1..553: note = derived and/or modified protein sequence (wt) from HRSV__AOS48683.1__F-del
MELLIHRSSAIFLTLTINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9341 - protein, 553 aa, synthetic construct
  REGION 1..553: note = derived and/or modified protein sequence (wt) from HRSV__AOS48551.1__F-del
MELPILKTNAITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9342 - protein, 553 aa, synthetic construct
  REGION 1..553: note = derived and/or modified protein sequence (wt) from HRSV__AOS48485.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALHSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSEYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9343 - protein, 553 aa, synthetic construct
  REGION 1..553: note = derived and/or modified protein sequence (wt) from HRSV__AOS48518.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFINYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9344 - protein, 553 aa, synthetic construct
  REGION 1..553: note = derived and/or modified protein sequence (wt) from HRSV__AOS48441.1__F-del
MELLIHRSSAIFLTLAINTLYLTSSQNITEEFYQSTCSAVSRGYFSALRTGWYTSVITIELSNIKETKCNGTDTKVKLIKQELDKYKNAVIELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKGEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9345 - protein, 553 aa, synthetic construct
  REGION 1..553: note = derived and/or modified protein sequence (wt) from HRSV__AOS48397.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKDGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9346 - protein, 553 aa, synthetic construct
  REGION 1..553: note = derived and/or modified protein sequence (wt) from HRSV__AOS48375.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFINYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKLEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9347 - protein, 553 aa, synthetic construct
  REGION 1..553: note = derived and/or modified protein sequence (wt) from HRSV__AOS48353.1__F-del
MELLIHRSSAIFLTFAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINKQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9348 - protein, 553 aa, synthetic construct
  REGION 1..553: note = derived and/or modified protein sequence (wt) from HRSV__AOS48287.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGIGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIIITTIIIVIIVILLALIAVGLLLYCKAR

SEQ ID NO: 9349 - protein, 553 aa, synthetic construct
  REGION 1..553: note = derived and/or modified protein sequence (wt) from HRSV__AOS48320.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYINYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9350 - protein, 553 aa, synthetic construct
  REGION 1..553: note = derived and/or modified protein sequence (wt) from HRSV__AOS48265.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINSQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9351 - protein, 553 aa, synthetic construct
  REGION 1..553: note = derived and/or modified protein sequence (wt) from HRSV__AOS48254.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTFNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9352 - protein, 553 aa, synthetic construct
  REGION 1..553: note = derived and/or modified protein sequence (wt) from HRSV__AOS48221.1__F-del
MELLIRRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIHRSDELLHNVNTGKSTTNIMITAIIIVIIVVLLSLIAIGLLLYCKAK

SEQ ID NO: 9353 - protein, 553 aa, synthetic construct
  REGION 1..553: note = derived and/or modified protein sequence (wt) from HRSV__ANZ79638.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMMTTIIIVIIVILLALIAVGLLLYCKAR

SEQ ID NO: 9354 - protein, 553 aa, synthetic construct
  REGION 1..553: note = derived and/or modified protein sequence (wt) from HRSV__ALC74025.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9355 - protein, 553 aa, synthetic construct
  REGION 1..553: note = derived and/or modified protein sequence (wt) from HRSV__AHV81286.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9356 - protein, 553 aa, synthetic construct
  REGION 1..553: note = derived and/or modified protein sequence (wt) from HRSV__AOD40516.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNANAGKSTTNIMITTIIIVIIVILLALIAVGLLLYCKAR

SEQ ID NO: 9357 - protein, 553 aa, synthetic construct
  REGION 1..553: note = derived and/or modified protein sequence (wt) from HRSV__AOD40125.1__F-del
MELPILKTNAITTILAAVTLCFASSQNITEEFYQSTCSAVSKGYLSALRTGWYTSVITVELSNIKENKCNGTDAKVKLIKQELDKYKNAVTELQLLMQSTPAANSRARRELPRSMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9358 - protein, 553 aa, synthetic construct
  REGION 1..553: note = derived and/or modified protein sequence (wt) from HRSV__AOD40104.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLGKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITIIIIVIIVILLALIAVGLLLYCKAR

SEQ ID NO: 9359 - protein, 553 aa, synthetic construct
  REGION 1..553: note = derived and/or modified protein sequence (wt) from HRSV__AOD40082.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLGKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9360 - protein, 553 aa, synthetic construct
  REGION 1..553: note = derived and/or modified protein sequence (wt) from HRSV__AOD39908.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITIIIIVIIVILLALIAVGLLLYCKAR

SEQ ID NO: 9361 - protein, 553 aa, synthetic construct
  REGION 1..553: note = derived and/or modified protein sequence (wt) from HRSV__AJF44826.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTPNNTKNTNVTLGKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITIIIIVIIVILLALIAVGLLLYCKAR

SEQ ID NO: 9362 - protein, 553 aa, synthetic construct
  REGION 1..553: note = derived and/or modified protein sequence (wt) from HRSV__AJF44506.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRSMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9363 - protein, 553 aa, synthetic construct
  REGION 1..553: note = derived and/or modified protein sequence (wt) from HRSV__AJF44535.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9364 - protein, 553 aa, synthetic construct
  REGION 1..553: note = derived and/or modified protein sequence (wt) from HRSV__ANZ80463.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNSRARRELPRFMNYTLNDTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9365 - protein, 553 aa, synthetic construct
  REGION 1..553: note = derived and/or modified protein sequence (wt) from HRSV__ANZ80408.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTIKTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITAIIIVIIVVLLSLIAIGLLLYCKAK

SEQ ID NO: 9366 - protein, 553 aa, synthetic construct
  REGION 1..553: note = derived and/or modified protein sequence (wt) from HRSV__ANZ80397.1__F-del
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLDGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9367 - protein, 553 aa, synthetic construct
  REGION 1..553: note = derived and/or modified protein sequence (wt) from HRSV__ANZ80386.1__F-del
MELLIHRSSAIFLTLAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9368 - protein, 553 aa, synthetic construct
  REGION 1..553: note = derived and/or modified protein sequence (wt) from HRSV__ANZ80331.1__F-del
MELPILKTNAIITILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQIPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9369 - protein, 553 aa, synthetic construct
  REGION 1..553: note = derived and/or modified protein sequence (wt) from HRSV__ANZ80320.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNYTKNTNVTLSKKRKRRFLGFLLGIGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9370 - protein, 553 aa, synthetic construct
  REGION 1..553: note = derived and/or modified protein sequence (wt) from HRSV__ANZ80364.1__F-del
MELPIFKTNAITTILAVVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9371 - protein, 553 aa, synthetic construct
  REGION 1..553: note = derived and/or modified protein sequence (wt) from HRSV__ANZ80276.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYVNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9372 - protein, 553 aa, synthetic construct
  REGION 1..553: note = derived and/or modified protein sequence (wt) from HRSV__ANZ80221.1__F-del
MELLIHRSNAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9373 - protein, 553 aa, synthetic construct
  REGION 1..553: note = derived and/or modified protein sequence (wt) from HRSV__ANZ80188.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTFNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9374 - protein, 553 aa, synthetic construct
  REGION 1..553: note = derived and/or modified protein sequence (wt) from HRSV__ANZ80144.1__F-del
MELPILKTNAITTILAAVTLCFASSQNITEEFYQSTCSAVSKGYLSALRTGWYTSVITIELSNIKENKCNGTDAKVKLIKQELDKYKNAITELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMMTTIIIVIIVILLALIAVGLLLYCKAR

SEQ ID NO: 9375 - protein, 553 aa, synthetic construct
  REGION 1..553: note = derived and/or modified protein sequence (wt) from HRSV__ANZ80133.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNRQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9376 - protein, 553 aa, synthetic construct
  REGION 1..553: note = derived and/or modified protein sequence (wt) from HRSV__ANZ80111.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAK

SEQ ID NO: 9377 - protein, 553 aa, synthetic construct
  REGION 1..553: note = derived and/or modified protein sequence (wt) from HRSV__ANZ80122.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTINLNISISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9378 - protein, 553 aa, synthetic construct
  REGION 1..553: note = derived and/or modified protein sequence (wt) from HRSV__ANZ80056.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFFNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9379 - protein, 553 aa, synthetic construct
  REGION 1..553: note = derived and/or modified protein sequence (wt) from HRSV__ANZ80012.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNYTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9380 - protein, 553 aa, synthetic construct
  REGION 1..553: note = derived and/or modified protein sequence (wt) from HRSV__ANZ80067.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGNLNVSIGKRRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9381 - protein, 553 aa, synthetic construct
  REGION 1..553: note = derived and/or modified protein sequence (wt) from HRSV__ANZ79979.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDISSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9382 - protein, 553 aa, synthetic construct
  REGION 1..553: note = derived and/or modified protein sequence (wt) from HRSV__ANZ79935.1__F-del
MELPILKTNAIITILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAK

SEQ ID NO: 9383 - protein, 553 aa, synthetic construct
  REGION 1..553: note = derived and/or modified protein sequence (wt) from HRSV__ANZ79990.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREVPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9384 - protein, 553 aa, synthetic construct
  REGION 1..553: note = derived and/or modified protein sequence (wt) from HRSV__ANZ79902.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNNELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9385 - protein, 553 aa, synthetic construct
  REGION 1..553: note = derived and/or modified protein sequence (wt) from HRSV__ANZ79759.1__F-del
MELPILKANAIATVLAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYKLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMMTTIIIVIIVILLALIAVGLLLYCKAR

SEQ ID NO: 9386 - protein, 553 aa, synthetic construct
  REGION 1..553: note = derived and/or modified protein sequence (wt) from HRSV__ANZ79715.1__F-del
MELPILKINAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQVVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9387 - protein, 553 aa, synthetic construct
  REGION 1..553: note = derived and/or modified protein sequence (wt) from HRSV__ANZ79671.1__F-del
MELPILKINAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNINAGKSTTNIMITTIIIVIIVILLALIAVGLLLYCKAR

SEQ ID NO: 9388 - protein, 553 aa, synthetic construct
  REGION 1..553: note = derived and/or modified protein sequence (wt) from HRSV__AMT79718.1__F-del
MELPILKTNAITTILAAVTLCFAFSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9389 - protein, 553 aa, synthetic construct
  REGION 1..553: note = derived and/or modified protein sequence (wt) from HRSV__AMT79586.1__F-del
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAASNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9390 - protein, 553 aa, synthetic construct
  REGION 1..553: note = derived and/or modified protein sequence (wt) from HRSV__AMT79553.1__F-del
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTINIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9391 - protein, 553 aa, synthetic construct
  REGION 1..553: note = derived and/or modified protein sequence (wt) from HRSV__AMT79542.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTSSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9392 - protein, 553 aa, synthetic construct
  REGION 1..553: note = derived and/or modified protein sequence (wt) from HRSV__AMT79476.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLASIAVGLLLYCKAR

SEQ ID NO: 9393 - protein, 553 aa, synthetic construct
  REGION 1..553: note = derived and/or modified protein sequence (wt) from HRSV__AMT79388.1__F-del
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAVASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSVIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9394 - protein, 553 aa, synthetic construct
  REGION 1..553: note = derived and/or modified protein sequence (wt) from HRSV__AMT79201.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANSRARREIPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9395 - protein, 553 aa, synthetic construct
  REGION 1..553: note = derived and/or modified protein sequence (wt) from HRSV__AMT79190.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGFGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9396 - protein, 553 aa, synthetic construct
  REGION 1..553: note = derived and/or modified protein sequence (wt) from HRSV__AMT79157.1__F-del
MELLIRRSSAIFLTFAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9397 - protein, 553 aa, synthetic construct
  REGION 1..553: note = derived and/or modified protein sequence (wt) from HRSV__AMT79124.1__F-del
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9398 - protein, 553 aa, synthetic construct
  REGION 1..553: note = derived and/or modified protein sequence (wt) from HRSV__AMT79091.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCHISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9399 - protein, 553 aa, synthetic construct
  REGION 1..553: note = derived and/or modified protein sequence (wt) from HRSV__AMT79047.1__F-del
MELPILKTNAITTILAAVTLCFTSSQNITEEFYQSTCSAVSKGYLSALRTGWYTSVITIELSNIKENKCNGTDTKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9400 - protein, 553 aa, synthetic construct
  REGION 1..553: note = derived and/or modified protein sequence (wt) from HRSV__AMT79014.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNANAGKSTTNIMITTIIIVIIVILLALIAVGLLLYCKAR

SEQ ID NO: 9401 - protein, 553 aa, synthetic construct
  REGION 1..553: note = derived and/or modified protein sequence (wt) from HRSV__AMT79003.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAR

SEQ ID NO: 9402 - protein, 553 aa, synthetic construct
  REGION 1..553: note = derived and/or modified protein sequence (wt) from HRSV__AMT78872.1__F-del
MELPILKTNAITTILTAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9403 - protein, 553 aa, synthetic construct
  REGION 1..553: note = derived and/or modified protein sequence (wt) from HRSV__AMT78832.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINYYDPLVFPSDEFDASISQVNEKINQSLAFIRKSDELLHNVNAGKSTTNIMITTIIIVIIVILLALIAVGLLLYCKAR

SEQ ID NO: 9404 - protein, 553 aa, synthetic construct
  REGION 1..553: note = derived and/or modified protein sequence (wt) from HRSV__AMT78689.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIIIIVILLALIAVGLLLYCKAR

SEQ ID NO: 9405 - protein, 553 aa, synthetic construct
  REGION 1..553: note = derived and/or modified protein sequence (wt) from HRSV__AMT78645.1__F-del
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSIYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9406 - protein, 553 aa, synthetic construct
  REGION 1..553: note = derived and/or modified protein sequence (wt) from HRSV__AMT78513.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRSRRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9407 - protein, 553 aa, synthetic construct
  REGION 1..553: note = derived and/or modified protein sequence (wt) from HRSV__AMT78480.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSILTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9408 - protein, 553 aa, synthetic construct
  REGION 1..553: note = derived and/or modified protein sequence (wt) from HRSV__AMT78447.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSNNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGKPIINYYDPLVFPSDEFDASISQVNEKINQSLAFIRRSDELLHNVNTGKSTTNIMITAIIIVIIVVLLSLIAIGLLLYCKAK

SEQ ID NO: 9409 - protein, 553 aa, synthetic construct
  REGION 1..553: note = derived and/or modified protein sequence (wt) from HRSV__AMT78392.1__F-del
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPVANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKTK

SEQ ID NO: 9410 - protein, 553 aa, synthetic construct
  REGION 1..553: note = derived and/or modified protein sequence (wt) from HRSV__AMT78194.1__F-del
MELLIHRSSAIFLNFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9411 - protein, 553 aa, synthetic construct
  REGION 1..553: note = derived and/or modified protein sequence (wt) from HRSV__AMT78084.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFTNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9412 - protein, 553 aa, synthetic construct
  REGION 1..553: note = derived and/or modified protein sequence (wt) from HRSV__AMT78051.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTDVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9413 - protein, 553 aa, synthetic construct
  REGION 1..553: note = derived and/or modified protein sequence (wt) from HRSV__AMT77963.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEDVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9414 - protein, 553 aa, synthetic construct
  REGION 1..553: note = derived and/or modified protein sequence (wt) from HRSV__AMT77908.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9415 - protein, 553 aa, synthetic construct
  REGION 1..553: note = derived and/or modified protein sequence (wt) from HRSV__AMT77776.1__F-del
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCRAK

SEQ ID NO: 9416 - protein, 553 aa, synthetic construct
  REGION 1..553: note = derived and/or modified protein sequence (wt) from HRSV__AMT77710.1__F-del
MELLIRRSSAIFLTLAINTLYLTSSQNITEEFYQSTCSAVSRGYFSALRTGWYTSVITIELSNIKETRCNGTDTKVKLIKQELDKYKNAVTELQLLMQNTPAANNRARREAPQYMNYTINTTKNPNASISKRRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9417 - protein, 553 aa, synthetic construct
  REGION 1..553: note = derived and/or modified protein sequence (wt) from HRSV__AMT77424.1__F-del
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNKKINQSLAFIRRSDELLHNVNTGKSTTNIMITAIIIVIIVVLLSLIAIGLLLYCKAK

SEQ ID NO: 9418 - protein, 553 aa, synthetic construct
  REGION 1..553: note = derived and/or modified protein sequence (wt) from HRSV__AMN91385.1__F-del
MELLIHRSSAIFLTLAINTLYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNPNASISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9419 - protein, 553 aa, synthetic construct
  REGION 1..553: note = derived and/or modified protein sequence (wt) from HRSV__AMN91264.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINATKNLNVSISKKRKRRFLGFLLGVGSAIASGIAVSKVLHLEGEVNKIKNALQSTNKAVVSLSNGVSVLTSKVLDLKNYINSQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9420 - protein, 553 aa, synthetic construct
  REGION 1..553: note = derived and/or modified protein sequence (wt) from HRSV__AMN91242.1__F-del
MELLIHRSSAIFLTFAINTLYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9421 - protein, 553 aa, synthetic construct
  REGION 1..553: note = derived and/or modified protein sequence (wt) from HRSV__AHX57504.1__F-del
MELPILKTNAITTILAAVTLCFASNQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9422 - protein, 553 aa, synthetic construct
  REGION 1..553: note = derived and/or modified protein sequence (wt) from HRSV__CUS01881.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRITNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9423 - protein, 553 aa, synthetic construct
  REGION 1..553: note = derived and/or modified protein sequence (wt) from HRSV__CUS01870.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTNIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9424 - protein, 553 aa, synthetic construct
  REGION 1..553: note = derived and/or modified protein sequence (wt) from HRSV__AMA67350.1__F-del
MELLIHRSSAIFLTLAINALYFTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9425 - protein, 553 aa, synthetic construct
  REGION 1..553: note = derived and/or modified protein sequence (wt) from HRSV__AMA67251.1__F-del
MELLIHRSSAIFLTLAINALCLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9426 - protein, 553 aa, synthetic construct
  REGION 1..553: note = derived and/or modified protein sequence (wt) from HRSV__AMA67262.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRVMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9427 - protein, 553 aa, synthetic construct
  REGION 1..553: note = derived and/or modified protein sequence (wt) from HRSV__AMA67229.1__F-del
MELPILKANAITTILIAVTFCFASSQNITEEFYQSTCSAVSKGYFSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9428 - protein, 553 aa, synthetic construct
  REGION 1..553: note = derived and/or modified protein sequence (wt) from HRSV__AMA67196.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAEKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9429 - protein, 553 aa, synthetic construct
  REGION 1..553: note = derived and/or modified protein sequence (wt) from HRSV__AMA67130.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELSRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9430 - protein, 553 aa, synthetic construct
  REGION 1..553: note = derived and/or modified protein sequence (wt) from HRSV__AMA67185.1__F-del
MELPILKTNAITTILAAVTLCLASSQNITEEFYQSTCSAVSKGYLSALRTGWYTSVITIELSNIKENKCNGTDAKVKLIKQELDKYKNAVTELQLLMQNTPAANNRARRELPRFMNYTLNNTKNTNATLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9431 - protein, 553 aa, synthetic construct
  REGION 1..553: note = derived and/or modified protein sequence (wt) from HRSV__AMA67163.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNRGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9432 - protein, 553 aa, synthetic construct
  REGION 1..553: note = derived and/or modified protein sequence (wt) from HRSV__AMA67086.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGIGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9433 - protein, 553 aa, synthetic construct
  REGION 1..553: note = derived and/or modified protein sequence (wt) from HRSV__AMA67075.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIVKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9434 - protein, 553 aa, synthetic construct
  REGION 1..553: note = derived and/or modified protein sequence (wt) from HRSV__AMA66998.1__F-del
MELPILKTNAITTILAAATLCFTSSQNITEEFYQSTCSAVSKGYLSALRTGWYTSVITIELSNIKENKCNGTDAKVKLIKQELDKYKNAVTELQLLMQSTPAANNRARRELPRFMNYTLDNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9435 - protein, 553 aa, synthetic construct
  REGION 1..553: note = derived and/or modified protein sequence (wt) from HRSV__AMA66987.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPKFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9436 - protein, 553 aa, synthetic construct
  REGION 1..553: note = derived and/or modified protein sequence (wt) from HRSV__AMA66976.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAIGLLLYCKAR

SEQ ID NO: 9437 - protein, 553 aa, synthetic construct
  REGION 1..553: note = derived and/or modified protein sequence (wt) from HRSV__AMA66965.1__F-del
MELLIHKSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLMAIGLLLYCKAK

SEQ ID NO: 9438 - protein, 553 aa, synthetic construct
  REGION 1..553: note = derived and/or modified protein sequence (wt) from HRSV__AMA66921.1__F-del
MELPILKTNAITTILAAATLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMSSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9439 - protein, 553 aa, synthetic construct
  REGION 1..553: note = derived and/or modified protein sequence (wt) from HRSV__AMA66844.1__F-del
MELLIYRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYTNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9440 - protein, 553 aa, synthetic construct
  REGION 1..553: note = derived and/or modified protein sequence (wt) from HRSV__AMA66833.1__F-del
MELPILKTNAITTILAAVTLCFASSQNITEEFYQATCSAVSKGYLSALRTGWYTSVITIELSNIKENKCNGTDAKVKLIKQELDKYKNAVTELQLLMQSTPAANNRARRELPKFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9441 - protein, 553 aa, synthetic construct
  REGION 1..553: note = derived and/or modified protein sequence (wt) from HRSV__AMA66624.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQKTPAVNNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCNNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9442 - protein, 553 aa, synthetic construct
  REGION 1..553: note = derived and/or modified protein sequence (wt) from HRSV__AMA66613.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYTNYTINTTKNLNVSISKKRKRRFLGFLLGVGSAIASGIAVSKVLHLEGEVNKIKSALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9443 - protein, 553 aa, synthetic construct
  REGION 1..553: note = derived and/or modified protein sequence (wt) from HRSV__AMA66591.1__F-del
MKLLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9444 - protein, 553 aa, synthetic construct
  REGION 1..553: note = derived and/or modified protein sequence (wt) from HRSV__AMA66569.1__F-del
MELLIHRSSAIFLTIAINALYLTSSQNITEEFYQSTCSAVSRGYFSALRTGWYTSVITIELSNIKETKCNGTDTKVKLIKQELDKYKNAVTELQLLMQNTPAANNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9445 - protein, 553 aa, synthetic construct
  REGION 1..553: note = derived and/or modified protein sequence (wt) from HRSV__AMA66547.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPKFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9446 - protein, 553 aa, synthetic construct
  REGION 1..553: note = derived and/or modified protein sequence (wt) from HRSV__AMA66503.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9447 - protein, 553 aa, synthetic construct
  REGION 1..553: note = derived and/or modified protein sequence (wt) from HRSV__AMA66492.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIMSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9448 - protein, 553 aa, synthetic construct
  REGION 1..553: note = derived and/or modified protein sequence (wt) from HRSV__AMA66481.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTFNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSNELLHNVNAGKSTTNIMITTIIIVIIVILLSLIAVGLLLYCKAR

SEQ ID NO: 9449 - protein, 553 aa, synthetic construct
  REGION 1..553: note = derived and/or modified protein sequence (wt) from HRSV__AMA66448.1__F-del
MELLIHRSSAIFLTLAINALYLTSSQNITEEFYQSTCSAVSRGYFSALRTGWYTSVITIELSNIKETKCNGTDTKVKLINQELDKYKNAVTELQLLMQNTPAANNRARREAPRYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9450 - protein, 553 aa, synthetic construct
  REGION 1..553: note = derived and/or modified protein sequence (wt) from HRSV__AMA66415.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9451 - protein, 553 aa, synthetic construct
  REGION 1..553: note = derived and/or modified protein sequence (wt) from HRSV__AMA66393.1__F-del
MELLIHKSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLMAIGLLLYCKAK

SEQ ID NO: 9452 - protein, 553 aa, synthetic construct
  REGION 1..553: note = derived and/or modified protein sequence (wt) from HRSV__AMA66360.1__F-del
MELPIFKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIVVGLLLYCKAR

SEQ ID NO: 9453 - protein, 553 aa, synthetic construct
  REGION 1..553: note = derived and/or modified protein sequence (wt) from HRSV__AGG39553.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTVNTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9454 - protein, 553 aa, synthetic construct
  REGION 1..553: note = derived and/or modified protein sequence (wt) from HRSV__AGG39469.1__F-del
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKAR

SEQ ID NO: 9455 - protein, 553 aa, synthetic construct
  REGION 1..553: note = derived and/or modified protein sequence (wt) from HRSV__AJZ70144.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTSSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9456 - protein, 553 aa, synthetic construct
  REGION 1..553: note = derived and/or modified protein sequence (wt) from HRSV__AJZ70166.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9457 - protein, 553 aa, synthetic construct
  REGION 1..553: note = derived and/or modified protein sequence (wt) from HRSV__AJZ70155.1__F-del
MELPILKTNAITTILAAVTICFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9458 - protein, 553 aa, synthetic construct
  REGION 1..553: note = derived and/or modified protein sequence (wt) from HRSV__AJZ70133.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRTRRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9459 - protein, 553 aa, synthetic construct
  REGION 1..553: note = derived and/or modified protein sequence (wt) from HRSV__AJZ70067.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9460 - protein, 553 aa, synthetic construct
  REGION 1..553: note = derived and/or modified protein sequence (wt) from HRSV__AJZ69946.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9461 - protein, 553 aa, synthetic construct
  REGION 1..553: note = derived and/or modified protein sequence (wt) from HRSV__AJZ69913.1__F-del
MELPILNTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9462 - protein, 553 aa, synthetic construct
  REGION 1..553: note = derived and/or modified protein sequence (wt) from HRSV__AJZ69880.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTPNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9463 - protein, 553 aa, synthetic construct
  REGION 1..553: note = derived and/or modified protein sequence (wt) from HRSV__AJZ69847.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9464 - protein, 553 aa, synthetic construct
  REGION 1..553: note = derived and/or modified protein sequence (wt) from HRSV__AJZ69869.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9465 - protein, 553 aa, synthetic construct
  REGION 1..553: note = derived and/or modified protein sequence (wt) from HRSV__AJO16077.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINITKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9466 - protein, 553 aa, synthetic construct
  REGION 1..553: note = derived and/or modified protein sequence (wt) from HRSV__AJO16055.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKHEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9467 - protein, 553 aa, synthetic construct
  REGION 1..553: note = derived and/or modified protein sequence (wt) from HRSV__AKE31881.1__F-del
MELLIHRSNAIFLTLAINALYLTSSQNITEEFYQSTCSAVSRGYFSALRTGWYTSVITIELSNIKETKCNGTDTKVKLMKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9468 - protein, 553 aa, synthetic construct
  REGION 1..553: note = derived and/or modified protein sequence (wt) from HRSV__AKE31882.1__F-del
MELLVHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9469 - protein, 553 aa, synthetic construct
  REGION 1..553: note = derived and/or modified protein sequence (wt) from HRSV__AKE31878.1__F-del
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAANNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQNCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9470 - protein, 553 aa, synthetic construct
  REGION 1..553: note = derived and/or modified protein sequence (wt) from HRSV__AJF44835.1__F-del
MDLPILKTNAITTIFAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNNKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9471 - protein, 553 aa, synthetic construct
  REGION 1..553: note = derived and/or modified protein sequence (wt) from HRSV__AJF44790.1__F-del
MELSILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9472 - protein, 553 aa, synthetic construct
  REGION 1..553: note = derived and/or modified protein sequence (wt) from HRSV__AJF44737.1__F-del
MELPILKTNVITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKYTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9473 - protein, 553 aa, synthetic construct
  REGION 1..553: note = derived and/or modified protein sequence (wt) from HRSV__AJF44716.1__F-del
MELLIHRSSAIFLTLAINALYLASSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLVAIGLLLYCKAK

SEQ ID NO: 9474 - protein, 553 aa, synthetic construct
  REGION 1..553: note = derived and/or modified protein sequence (wt) from HRSV__AJF44725.1__F-del
MELPILKTNVITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKYTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9475 - protein, 553 aa, synthetic construct
  REGION 1..553: note = derived and/or modified protein sequence (wt) from HRSV__AJF44643.1__F-del
MELLIHRSSAIFLTLAINALYLASSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9476 - protein, 553 aa, synthetic construct
  REGION 1..553: note = derived and/or modified protein sequence (wt) from HRSV__AJF44628.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9477 - protein, 553 aa, synthetic construct
  REGION 1..553: note = derived and/or modified protein sequence (wt) from HRSV__AJF44624.1__F-del
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAINNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNNRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9478 - protein, 553 aa, synthetic construct
  REGION 1..553: note = derived and/or modified protein sequence (wt) from HRSV__AJF44613.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNSNVSTIKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9479 - protein, 553 aa, synthetic construct
  REGION 1..553: note = derived and/or modified protein sequence (wt) from HRSV__AJF44566.1__F-del
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAINNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9480 - protein, 553 aa, synthetic construct
  REGION 1..553: note = derived and/or modified protein sequence (wt) from HRSV__AJF44555.1__F-del
MELLIHRSSAIFLTLAINALYLTSSQNITEEFYQSTCSAVSRGYFSALRTGWYTSVITIELSNIQETNCNGTDTKVKLIKQELDKYKNAVTELQLLMQNTPAINNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9481 - protein, 553 aa, synthetic construct
  REGION 1..553: note = derived and/or modified protein sequence (wt) from HRSV__AJF44526.1__F-del
MELLIHRSSAIFLTLAINALYLTSSQNITEEFYQSTCSAVSRGYFSALRTGWYTSVITIELSNIKETKCNGTDTKVRLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9482 - protein, 553 aa, synthetic construct
  REGION 1..553: note = derived and/or modified protein sequence (wt) from HRSV__AJF44517.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9483 - protein, 553 aa, synthetic construct
  REGION 1..553: note = derived and/or modified protein sequence (wt) from HRSV__AKA45882.1__F-del
MELPILKTNAITTILTAVTLCFASSQNITEEFYQSTCSAVSKGYLSALRTGWYTSVITIELSNIKENKCNGTDAKVKLIKQELDKYKNAVTELQLLMQSTPAANNRARRELSRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9484 - protein, 553 aa, synthetic construct
  REGION 1..553: note = derived and/or modified protein sequence (wt) from HRSV__AKA45849.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9485 - protein, 553 aa, synthetic construct
  REGION 1..553: note = derived and/or modified protein sequence (wt) from HRSV__AHA83913.1__F-del
MELLIHRSSAIFLTLAINALYLTSSQNITEEFYQSTCSAVSRGYISALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9486 - protein, 553 aa, synthetic construct
  REGION 1..553: note = derived and/or modified protein sequence (wt) from HRSV__AGN28715.1__F-del
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9487 - protein, 553 aa, synthetic construct
  REGION 1..553: note = derived and/or modified protein sequence (wt) from HRSV__AHA83902.1__F-del
MELLIHRSSAIFLTLAINALYLTSSQNITEEFYQSTCSAVSRGYISALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLMFPSDEFDASISQVNEKINQSLAFIRRSDELLHNVNTGKSTTNIMITAIIIVIIVVLLSLIAIGLLLYCKAK

SEQ ID NO: 9488 - protein, 553 aa, synthetic construct
  REGION 1..553: note = derived and/or modified protein sequence (wt) from HRSV__AHA83837.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9489 - protein, 553 aa, synthetic construct
  REGION 1..553: note = derived and/or modified protein sequence (wt) from HRSV__AHA83826.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSNELLHNVNVGKSTTNIMITTIIIVIIVILLLLIAVGLFLYCKAR

SEQ ID NO: 9490 - protein, 553 aa, synthetic construct
  REGION 1..553: note = derived and/or modified protein sequence (wt) from HRSV__AHA83705.1__F-del
MELLIHRSSAIFLTFAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCNAK

SEQ ID NO: 9491 - protein, 553 aa, synthetic construct
  REGION 1..553: note = derived and/or modified protein sequence (wt) from HRSV__AHA83630.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCRAR

SEQ ID NO: 9492 - protein, 553 aa, synthetic construct
  REGION 1..553: note = derived and/or modified protein sequence (wt) from HRSV__AGG39505.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNTKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9493 - protein, 553 aa, synthetic construct
  REGION 1..553: note = derived and/or modified protein sequence (wt) from HRSV__AIY70242.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAVKSTTNIMITTIIIVIIVILLSLIVVGLLLYCKAR

SEQ ID NO: 9494 - protein, 553 aa, synthetic construct
  REGION 1..553: note = derived and/or modified protein sequence (wt) from HRSV__AIY70198.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTENTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVSLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAVKSTTNIMITTIIIVIIVILLSLIVVGLLLYCKAR

SEQ ID NO: 9495 - protein, 553 aa, synthetic construct
  REGION 1..553: note = derived and/or modified protein sequence (wt) from HRSV__AII30203.1__F-del
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPKFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRRQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9496 - protein, 553 aa, synthetic construct
  REGION 1..553: note = derived and/or modified protein sequence (wt) from HRSV__AHY21463.1__F-del
MELPILKTNAITTIFAAVTLCFASSQNITEEFYQSTCSAVSKGYLSALRTGWYTSVITVELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9497 - protein, 553 aa, synthetic construct
  REGION 1..553: note = derived and/or modified protein sequence (wt) from HRSV__AHY21397.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYTNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9498 - protein, 553 aa, synthetic construct
  REGION 1..553: note = derived and/or modified protein sequence (wt) from HRSV__AHY21320.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKEVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9499 - protein, 553 aa, synthetic construct
  REGION 1..553: note = derived and/or modified protein sequence (wt) from HRSV__AHY21298.1__F-del
MELMIHKSSAIFLTLAINALYLTSSQNITEEFYQSTCSAVSRGYFSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITTIIIVIIVVLLSLIAIGLLLYCKAK

SEQ ID NO: 9500 - protein, 553 aa, synthetic construct
  REGION 1..553: note = derived and/or modified protein sequence (wt) from HRSV__AHY21287.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9501 - protein, 553 aa, synthetic construct
  REGION 1..553: note = derived and/or modified protein sequence (wt) from HRSV__AHY21276.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNSRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9502 - protein, 553 aa, synthetic construct
  REGION 1..553: note = derived and/or modified protein sequence (wt) from HRSV__AHY21254.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLSSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9503 - protein, 553 aa, synthetic construct
  REGION 1..553: note = derived and/or modified protein sequence (wt) from HRSV__AHY21199.1__F-del
MELLIHRSSAIFLTIAINALYLTSSQNITEEFYQSTCSAVSRGYFSALRTGWYTSVITIELSNIKETKCNGTDTKVKLIKQELDKYKNAVTELQLLMQNTPATNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9504 - protein, 553 aa, synthetic construct
  REGION 1..553: note = derived and/or modified protein sequence (wt) from HRSV__AHY21176.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9505 - protein, 553 aa, synthetic construct
  REGION 1..553: note = derived and/or modified protein sequence (wt) from HRSV__AHX57537.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSSPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9506 - protein, 553 aa, synthetic construct
  REGION 1..553: note = derived and/or modified protein sequence (wt) from HRSV__AHX57471.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSSPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9507 - protein, 553 aa, synthetic construct
  REGION 1..553: note = derived and/or modified protein sequence (wt) from HRSV__AHX57427.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVKAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9508 - protein, 553 aa, synthetic construct
  REGION 1..553: note = derived and/or modified protein sequence (wt) from HRSV__AHX57042.1__F-del
MELLIHRSSVIFLTLAINALYLTSSQNITEEFYQSTCSAVSRGYFSALRTGWYTSVITIELSNIKETKCNGTDTKVKLIKQELDKYKNAVTELQLLMQNIPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9509 - protein, 553 aa, synthetic construct
  REGION 1..553: note = derived and/or modified protein sequence (wt) from HRSV__AIZ95981.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYIVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNEFDASISQVNEKINQSLAFIRKSDELLHNVNAGKSTTNIMITTIIIVIIVILLSLIAVGLLLYCKAR

SEQ ID NO: 9510 - protein, 553 aa, synthetic construct
  REGION 1..553: note = derived and/or modified protein sequence (wt) from HRSV__AIZ95893.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNVMITTIIIVIIVILLSLIAVGLLLYCKAR

SEQ ID NO: 9511 - protein, 553 aa, synthetic construct
  REGION 1..553: note = derived and/or modified protein sequence (wt) from HRSV__AIZ95871.1__F-del
MELLIHKSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAIVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9512 - protein, 553 aa, synthetic construct
  REGION 1..553: note = derived and/or modified protein sequence (wt) from HRSV__AIZ95816.1__F-del
MELPILKTNAITIILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNSTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9513 - protein, 553 aa, synthetic construct
  REGION 1..553: note = derived and/or modified protein sequence (wt) from HRSV__AIZ95772.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSTGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9514 - protein, 553 aa, synthetic construct
  REGION 1..553: note = derived and/or modified protein sequence (wt) from HRSV__AIZ95629.1__F-del
MELLIHRSSAIFLTLAINALYFTSGQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSTSKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9515 - protein, 553 aa, synthetic construct
  REGION 1..553: note = derived and/or modified protein sequence (wt) from HRSV__AIZ95673.1__F-del
MESLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9516 - protein, 553 aa, synthetic construct
  REGION 1..553: note = derived and/or modified protein sequence (wt) from HRSV__AIZ95596.1__F-del
MELPILKTNAITTILAAATLCFASSQNITEEFYQSTCSAVSKGYLSALRTGWYTSVITIELSNIKENKCNGTDVKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9517 - protein, 553 aa, synthetic construct
  REGION 1..553: note = derived and/or modified protein sequence (wt) from HRSV__AIZ95585.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNSTKNTNVTLSKKRKRRFLGFLLGVGSAIASGIAVSKVLHLEGEVDKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9518 - protein, 553 aa, synthetic construct
  REGION 1..553: note = derived and/or modified protein sequence (wt) from HRSV__AIZ95552.1__F-del
MELPILKTNAITTILAAVTLCLASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9519 - protein, 553 aa, synthetic construct
  REGION 1..553: note = derived and/or modified protein sequence (wt) from HRSV__AHX57570.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLKNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9520 - protein, 553 aa, synthetic construct
  REGION 1..553: note = derived and/or modified protein sequence (wt) from HRSV__AHX57152.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKYTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9521 - protein, 553 aa, synthetic construct
  REGION 1..553: note = derived and/or modified protein sequence (wt) from HRSV__AHX57064.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNGELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLYNVNAGKSTTNIMITTIIIVIIVILLALIAVGLLLYCKAR

SEQ ID NO: 9522 - protein, 553 aa, synthetic construct
  REGION 1..553: note = derived and/or modified protein sequence (wt) from HRSV__AHX57009.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVILSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9523 - protein, 553 aa, synthetic construct
  REGION 1..553: note = derived and/or modified protein sequence (wt) from HRSV__AHX56987.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTIKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNINTGKSTTNIMITVIIIVIIVVLLSLIAIGLLLYCKAK

SEQ ID NO: 9524 - protein, 553 aa, synthetic construct
  REGION 1..553: note = derived and/or modified protein sequence (wt) from HRSV__AHV82100.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9525 - protein, 553 aa, synthetic construct
  REGION 1..553: note = derived and/or modified protein sequence (wt) from HRSV__AHV82001.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNTKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9526 - protein, 553 aa, synthetic construct
  REGION 1..553: note = derived and/or modified protein sequence (wt) from HRSV__AHV81891.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9527 - protein, 553 aa, synthetic construct
  REGION 1..553: note = derived and/or modified protein sequence (wt) from HRSV__AHV81880.1__F-del
MDLPILKTNAITTILAAVTLCFTSSQNITEEFYQSTCSAVSKGYLSALRTGWYTSVITIELSNIKENKCNGTDAKVKLIKQELDKYKNAVTELQLLMQSTPASNNRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9528 - protein, 553 aa, synthetic construct
  REGION 1..553: note = derived and/or modified protein sequence (wt) from HRSV__AHV81836.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNCTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9529 - protein, 553 aa, synthetic construct
  REGION 1..553: note = derived and/or modified protein sequence (wt) from HRSV__AHV81682.1__F-del
MELPVLKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9530 - protein, 553 aa, synthetic construct
  REGION 1..553: note = derived and/or modified protein sequence (wt) from HRSV__AHV81649.1__F-del
MELPIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9531 - protein, 553 aa, synthetic construct
  REGION 1..553: note = derived and/or modified protein sequence (wt) from HRSV__AHV81484.1__F-del
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9532 - protein, 553 aa, synthetic construct
  REGION 1..553: note = derived and/or modified protein sequence (wt) from HRSV__AHV81462.1__F-del
MELPILKTNAITTILAAVTLCFASSQNITEEFYQSTCSAVSKGYLSALRTGWYTSVITIELSNIKENKCNGTDAKVKLIKQELDRYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9533 - protein, 553 aa, synthetic construct
  REGION 1..553: note = derived and/or modified protein sequence (wt) from HRSV__AHV81385.1__F-del
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9534 - protein, 553 aa, synthetic construct
  REGION 1..553: note = derived and/or modified protein sequence (wt) from HRSV__AHV81363.1__F-del
MELPILKTNAITTVLAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9535 - protein, 553 aa, synthetic construct
  REGION 1..553: note = derived and/or modified protein sequence (wt) from HRSV__AHV81330.1__F-del
MELPILKTNAITTILAAVTLCFASSQNITEEFYQSTCSAVSKGFLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9536 - protein, 553 aa, synthetic construct
  REGION 1..553: note = derived and/or modified protein sequence (wt) from HRSV__AHV81253.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTNNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9537 - protein, 553 aa, synthetic construct
  REGION 1..553: note = derived and/or modified protein sequence (wt) from HRSV__AHV81154.1__F-del
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9538 - protein, 553 aa, synthetic construct
  REGION 1..553: note = derived and/or modified protein sequence (wt) from HRSV__AHV81122.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTNNTNVTLSKKRKRRFLGFLLGVGSAIASGIAVSKVLHLEGEVKKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9539 - protein, 553 aa, synthetic construct
  REGION 1..553: note = derived and/or modified protein sequence (wt) from HRSV__AHV81089.1__F-del
MGLLIHGSSAVFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9540 - protein, 553 aa, synthetic construct
  REGION 1..553: note = derived and/or modified protein sequence (wt) from HRSV__AHV81012.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNNTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9541 - protein, 553 aa, synthetic construct
  REGION 1..553: note = derived and/or modified protein sequence (wt) from HRSV__AHV80957.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNHTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNTDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9542 - protein, 553 aa, synthetic construct
  REGION 1..553: note = derived and/or modified protein sequence (wt) from HRSV__AHV80880.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYILNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9543 - protein, 553 aa, synthetic construct
  REGION 1..553: note = derived and/or modified protein sequence (wt) from HRSV__AHV80869.1__F-del
MELPILKTNAITTILAAVTLCLASSQNITEEFYQSTCSAVSKGYLSALRTGWYTSVITIELSNIKENKCNGTDAKVKLIKQELDKYKNAVTELQLLMQSTPAANSRARRELPRFRNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9544 - protein, 553 aa, synthetic construct
  REGION 1..553: note = derived and/or modified protein sequence (wt) from HRSV__AHV80836.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCATNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9545 - protein, 553 aa, synthetic construct
  REGION 1..553: note = derived and/or modified protein sequence (wt) from HRSV__AHV80803.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKDALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9546 - protein, 553 aa, synthetic construct
  REGION 1..553: note = derived and/or modified protein sequence (wt) from HRSV__AGG39559.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQQLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9547 - protein, 553 aa, synthetic construct
  REGION 1..553: note = derived and/or modified protein sequence (wt) from HRSV__AGG39562.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPSANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9548 - protein, 553 aa, synthetic construct
  REGION 1..553: note = derived and/or modified protein sequence (wt) from HRSV__AGG39556.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9549 - protein, 553 aa, synthetic construct
  REGION 1..553: note = derived and/or modified protein sequence (wt) from HRSV__AGG39550.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRIFNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9550 - protein, 553 aa, synthetic construct
  REGION 1..553: note = derived and/or modified protein sequence (wt) from HRSV__AGG39547.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPILNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9551 - protein, 553 aa, synthetic construct
  REGION 1..553: note = derived and/or modified protein sequence (wt) from HRSV__AGG39544.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQILPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9552 - protein, 553 aa, synthetic construct
  REGION 1..553: note = derived and/or modified protein sequence (wt) from HRSV__AGG39541.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRIFNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9553 - protein, 553 aa, synthetic construct
  REGION 1..553: note = derived and/or modified protein sequence (wt) from HRSV__AGG39529.1__F-del
MELLIHRSNAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9554 - protein, 553 aa, synthetic construct
  REGION 1..553: note = derived and/or modified protein sequence (wt) from HRSV__AGG39526.1__F-del
MELLIHRSSAIFLTLAINALYLTSSQNITEEFYQSTCSAVSRGYFSALRTGWYTSVITIELSNIKETKCNGTDTKVKLIKQELNKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9555 - protein, 553 aa, synthetic construct
  REGION 1..553: note = derived and/or modified protein sequence (wt) from HRSV__AGG39523.1__F-del
MELLIHRSIAIFLTLAINALYLTSSQNITEEFYQSTCSAVSRGYFSALRTGWYTSVITIELSNITETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNVGKSTTNIMITAIIIVIIVVLLSLIAIGLLLYCKAK

SEQ ID NO: 9556 - protein, 553 aa, synthetic construct
  REGION 1..553: note = derived and/or modified protein sequence (wt) from HRSV__AGG39514.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPVANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNTKEGSNICLTRTDRGWYCDNAGSVSFFPQADTCKVQSNRVFCDTMYSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9557 - protein, 553 aa, synthetic construct
  REGION 1..553: note = derived and/or modified protein sequence (wt) from HRSV__AGG39502.1__F-del
MELLVHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTNNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9558 - protein, 553 aa, synthetic construct
  REGION 1..553: note = derived and/or modified protein sequence (wt) from HRSV__AGG39499.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNIPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9559 - protein, 553 aa, synthetic construct
  REGION 1..553: note = derived and/or modified protein sequence (wt) from HRSV__AGG39496.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGISVLTSKVLDLKNYINNQLLPIVNQQSCRITNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9560 - protein, 553 aa, synthetic construct
  REGION 1..553: note = derived and/or modified protein sequence (wt) from HRSV__AGG39493.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQQLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAK

SEQ ID NO: 9561 - protein, 553 aa, synthetic construct
  REGION 1..553: note = derived and/or modified protein sequence (wt) from HRSV__AGG39484.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRITNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9562 - protein, 553 aa, synthetic construct
  REGION 1..553: note = derived and/or modified protein sequence (wt) from HRSV__AGG39490.1__F-del
MELLIHRSSAIFLTLAINALYFTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9563 - protein, 553 aa, synthetic construct
  REGION 1..553: note = derived and/or modified protein sequence (wt) from HRSV__AGG39487.1__F-del
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGISVLTSKVLDLKNYINNRLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAK

SEQ ID NO: 9564 - protein, 553 aa, synthetic construct
  REGION 1..553: note = derived and/or modified protein sequence (wt) from HRSV__AGG39475.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9565 - protein, 553 aa, synthetic construct
  REGION 1..553: note = derived and/or modified protein sequence (wt) from HRSV__AGG39466.1__F-del
MELLILKANVIATILTAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9566 - protein, 553 aa, synthetic construct
  REGION 1..553: note = derived and/or modified protein sequence (wt) from HRSV__AGG39463.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNNELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9567 - protein, 553 aa, synthetic construct
  REGION 1..553: note = derived and/or modified protein sequence (wt) from HRSV__AGG39454.1__F-del
MELPILKINAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9568 - protein, 553 aa, synthetic construct
  REGION 1..553: note = derived and/or modified protein sequence (wt) from HRSV__AGG39442.1__F-del
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTFNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9569 - protein, 553 aa, synthetic construct
  REGION 1..553: note = derived and/or modified protein sequence (wt) from HRSV__AGG39439.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9570 - protein, 553 aa, synthetic construct
  REGION 1..553: note = derived and/or modified protein sequence (wt) from HRSV__AGG39436.1__F-del
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTFNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9571 - protein, 553 aa, synthetic construct
  REGION 1..553: note = derived and/or modified protein sequence (wt) from HRSV__AGG39415.1__F-del
MDLPILKTNAITTILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9572 - protein, 553 aa, synthetic construct
  REGION 1..553: note = derived and/or modified protein sequence (wt) from HRSV__AGG39403.1__F-del
MELPILKTNAITTILAAVTLCFASSQNITEEFYQSTCSAVSKGYLSALRTGWYTSVITIELSNIKENMCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9573 - protein, 553 aa, synthetic construct
  REGION 1..553: note = derived and/or modified protein sequence (wt) from HRSV__AGG39397.1__F-del
MELPIIKANAITTILIAVTFCFASSQNITEEFYQSTCSAVSKGYLSALRTGWYTSVITIELSNIKENKCNGTDAKVKLIKQELDKYKNAVTELQLLMQSTTAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9574 - protein, 553 aa, synthetic construct
  REGION 1..553: note = derived and/or modified protein sequence (wt) from HRSV__AGG39391.1__F-del
MDLPILKTNAITAILAAVSLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9575 - protein, 553 aa, synthetic construct
  REGION 1..553: note = derived and/or modified protein sequence (wt) from HRSV__AGG39379.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9576 - protein, 553 aa, synthetic construct
  REGION 1..553: note = derived and/or modified protein sequence (wt) from HRSV__AHL84194.1__F-del
MELLILKANAITTILTAVTFCFASGQNITEEFYQSTCSAVSKGYLSALRTGWYTSVITIELSNIKKNKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9577 - protein, 553 aa, synthetic construct
  REGION 1..553: note = derived and/or modified protein sequence (wt) from HRSV__AHA84012.1__F-del
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAANNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMMTAIIIVIIVVLLSLIAIGLLLYCKAK

SEQ ID NO: 9578 - protein, 553 aa, synthetic construct
  REGION 1..553: note = derived and/or modified protein sequence (wt) from HRSV__AHJ60043.1__F-del
MELLIHRSSAIFLTLAINALYLTSSQNITEEFYQSTCSAVSRGYFSALRTGWYTSVITIELSNITETKCNGTDTKVKLIKQELDKYKNAVTELQLLMQNTPAANNRARREAPQHMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRIFNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRKSDELLHNVNTGKSTTNIMITTIIIVIIVVLLSLIAIGLLLYCKAK

SEQ ID NO: 9579 - protein, 553 aa, synthetic construct
  REGION 1..553: note = derived and/or modified protein sequence (wt) from HRSV__BAO49770.1__F-del
MELPILKTNAITTILAAVTLCFASSQNITEEFYQSTCSAVSKGYLSALRTGGYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSAPLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9580 - protein, 553 aa, synthetic construct
  REGION 1..553: note = derived and/or modified protein sequence (wt) from HRSV__BAO49766.1__F-del
MELPILKTNAITTILAAVTLCFASSQNITEEFYQSTCSAVSKGYLSALRTGWYTSVITIELSNIKENKCNGPDAKVKLIKQELDKYKNAVTELQLLMQSTPAGNSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9581 - protein, 553 aa, synthetic construct
  REGION 1..553: note = derived and/or modified protein sequence (wt) from HRSV__BAO49767.1__F-del
MELPILKTNAITTILAAVTLCFASSQNITEEFYQSTCSAVCKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9582 - protein, 553 aa, synthetic construct
  REGION 1..553: note = derived and/or modified protein sequence (wt) from HRSV__AHA84034.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVDLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9583 - protein, 553 aa, synthetic construct
  REGION 1..553: note = derived and/or modified protein sequence (wt) from HRSV__AHA84023.1__F-del
MELPILKTNAITTIFATVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9584 - protein, 553 aa, synthetic construct
  REGION 1..553: note = derived and/or modified protein sequence (wt) from HRSV__AHA83990.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRIFNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9585 - protein, 553 aa, synthetic construct
  REGION 1..553: note = derived and/or modified protein sequence (wt) from HRSV__AHA83957.1__F-del
MELPILKTNAITTILAVVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKAR

SEQ ID NO: 9586 - protein, 553 aa, synthetic construct
  REGION 1..553: note = derived and/or modified protein sequence (wt) from HRSV__AHA83924.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNIPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNFYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9587 - protein, 553 aa, synthetic construct
  REGION 1..553: note = derived and/or modified protein sequence (wt) from HRSV__AHA83891.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINATKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9588 - protein, 553 aa, synthetic construct
  REGION 1..553: note = derived and/or modified protein sequence (wt) from HRSV__AHA83880.1__F-del
MDLPILKINAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9589 - protein, 553 aa, synthetic construct
  REGION 1..553: note = derived and/or modified protein sequence (wt) from HRSV__AHA83782.1__F-del
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9590 - protein, 553 aa, synthetic construct
  REGION 1..553: note = derived and/or modified protein sequence (wt) from HRSV__AHA83760.1__F-del
MELPIINTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYMDKQLLPIVNKQSCSISNIETVIEFQQKNNRLLEITREFSVNAGVTTPVSTYMLTNNELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9591 - protein, 553 aa, synthetic construct
  REGION 1..553: note = derived and/or modified protein sequence (wt) from HRSV__AHA83694.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSDVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9592 - protein, 553 aa, synthetic construct
  REGION 1..553: note = derived and/or modified protein sequence (wt) from HRSV__AGT75357.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTIPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9593 - protein, 553 aa, synthetic construct
  REGION 1..553: note = derived and/or modified protein sequence (wt) from HRSV__AGN92848.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTINNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLLFPSDEFDASISQVNEKINQSLAFIRKSDELLHNVNAGKSTTNIMITTIIIVIIVILLALIAVGLLLYCKAR

SEQ ID NO: 9594 - protein, 553 aa, synthetic construct
  REGION 1..553: note = derived and/or modified protein sequence (wt) from HRSV__AGN28792.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9595 - protein, 553 aa, synthetic construct
  REGION 1..553: note = derived and/or modified protein sequence (wt) from HRSV__AGN28781.1__F-del
MELLIHRSSAIFLTLAINALYLTSSQNITEEFYQSTCSAVSRGYFSALRTGWYTSVITIELSNIKEIKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9596 - protein, 553 aa, synthetic construct
  REGION 1..553: note = derived and/or modified protein sequence (wt) from HRSV__AGN28759.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNIPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9597 - protein, 553 aa, synthetic construct
  REGION 1..553: note = derived and/or modified protein sequence (wt) from HRSV__AGN28748.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNINTGKSTTNIMITAIIIVIIVVLLSLIAIGLLLYCKAK

SEQ ID NO: 9598 - protein, 553 aa, synthetic construct
  REGION 1..553: note = derived and/or modified protein sequence (wt) from HRSV__AGN28693.1__F-del
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKKLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9599 - protein, 553 aa, synthetic construct
  REGION 1..553: note = derived and/or modified protein sequence (wt) from HRSV__AGN28638.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCKAQ

SEQ ID NO: 9600 - protein, 553 aa, synthetic construct
  REGION 1..553: note = derived and/or modified protein sequence (wt) from HRSV__AGN28627.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIREGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9601 - protein, 553 aa, synthetic construct
  REGION 1..553: note = derived and/or modified protein sequence (wt) from HRSV__AGN28539.1__F-del
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9602 - protein, 553 aa, synthetic construct
  REGION 1..553: note = derived and/or modified protein sequence (wt) from HRSV__AGN28528.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREASQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9603 - protein, 553 aa, synthetic construct
  REGION 1..553: note = derived and/or modified protein sequence (wt) from HRSV__AGN28462.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9604 - protein, 553 aa, synthetic construct
  REGION 1..553: note = derived and/or modified protein sequence (wt) from HRSV__AGN28440.1__F-del
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAK

SEQ ID NO: 9605 - protein, 553 aa, synthetic construct
  REGION 1..553: note = derived and/or modified protein sequence (wt) from HRSV__AGL96787.1__F-del
MEVPILKTNAITTILTAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTANIMITTIIIVIIVILLALIAVGLLLYCKAR

SEQ ID NO: 9606 - protein, 553 aa, synthetic construct
  REGION 1..553: note = derived and/or modified protein sequence (wt) from HRSV__AGL96786.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKTDELLHNVNAGKSTTNIMITTIIIVIIVILLALIAVGLLLYCKAR

SEQ ID NO: 9607 - protein, 553 aa, synthetic construct
  REGION 1..553: note = derived and/or modified protein sequence (wt) from HRSV__AGL96784.1__F-del
MELPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQTETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCRAR

SEQ ID NO: 9608 - protein, 553 aa, synthetic construct
  REGION 1..553: note = derived and/or modified protein sequence (wt) from HRSV__AAS93662.1__F-del
MELLIHRSSAIFLTLSINALYLTSSQNITEEFYQSTCSAVSRGYFSALRTGWYTSVITIELSNIKETKCNGTDTKVKLIKQELDKYKNAVTELQLLMQNTPATNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTQCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9609 - protein, 553 aa, synthetic construct
  REGION 1..553: note = derived and/or modified protein sequence (wt) from HRSV__AAS93657.1__F-del
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9610 - protein, 553 aa, synthetic construct
  REGION 1..553: note = derived and/or modified protein sequence (wt) from HRSV__AAS93656.1__F-del
MELPILKTNAITTILAAAILCFTSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCRAR

SEQ ID NO: 9611 - protein, 553 aa, synthetic construct
  REGION 1..553: note = derived and/or modified protein sequence (wt) from HRSV__AAS93659.1__F-del
MELVIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSVIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9612 - protein, 553 aa, synthetic construct
  REGION 1..553: note = derived and/or modified protein sequence (wt) from HRSV__AAS93660.1__F-del
MELLIHRSSAIFLTLAINALYLTSSQNITEEFYQSTCSVVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9613 - protein, 553 aa, synthetic construct
  REGION 1..553: note = derived and/or modified protein sequence (wt) from HRSV__AAS93663.1__F-del
MELLIHRSSAIFLTFAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9614 - protein, 553 aa, synthetic construct
  REGION 1..553: note = derived and/or modified protein sequence (wt) from HRSV__AAS93664.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPHYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9615 - protein, 553 aa, synthetic construct
  REGION 1..553: note = derived and/or modified protein sequence (wt) from HRSV__AAS93655.1__F-del
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCENAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKAR

SEQ ID NO: 9616 - protein, 553 aa, synthetic construct
  REGION 1..553: note = derived and/or modified protein sequence (wt) from HRSV__AHG54517.1__F-del
MELLIHRSSAIFLTLAINALYLTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9617 - protein, 553 aa, synthetic construct
  REGION 1..553: note = derived and/or modified protein sequence (wt) from HRSV__ASF87348.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9618 - protein, 553 aa, synthetic construct
  REGION 1..553: note = derived and/or modified protein sequence (wt) from HRSV__ASF87341.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKKNRLLENTKEFSVYLGVTTPLGTFMLTNSELLSLINDMPITNDQKKLMSHNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9619 - protein, 553 aa, synthetic construct
  REGION 1..553: note = derived and/or modified protein sequence (wt) from HRSV__ASF87344.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKKTNVTLSKKRKRRFLGFLLGVGSAIASGIAVSKVLHLEGEVNKIKSALLSTNKAVVSLSNGLSVLTSKGLNPKNYIEKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFGDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9620 - protein, 553 aa, synthetic construct
  REGION 1..553: note = derived and/or modified protein sequence (wt) from HRSV__ASF87351.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9621 - protein, 553 aa, synthetic construct
  REGION 1..553: note = derived and/or modified protein sequence (wt) from HRSV__ASF87338.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVPFPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9622 - protein, 553 aa, synthetic construct
  REGION 1..553: note = derived and/or modified protein sequence (wt) from HRSV__ASF87342.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVMAGVTTPVATIMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9623 - protein, 553 aa, synthetic construct
  REGION 1..553: note = derived and/or modified protein sequence (wt) from HRSV__ASF87352.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYALNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLIHDMPITNDQKKLMSHNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9624 - protein, 553 aa, synthetic construct
  REGION 1..553: note = derived and/or modified protein sequence (wt) from HRSV__ASF87337.1__F-del
MELPILKQNAITSILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFWDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9625 - protein, 553 aa, synthetic construct
  REGION 1..553: note = derived and/or modified protein sequence (wt) from HRSV__ASF87336.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9626 - protein, 553 aa, synthetic construct
  REGION 1..553: note = derived and/or modified protein sequence (wt) from HRSV__AEQ98756.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9627 - protein, 553 aa, synthetic construct
  REGION 1..553: note = derived and/or modified protein sequence (wt) from HRSV__AEQ98757.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPISTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9628 - protein, 553 aa, synthetic construct
  REGION 1..553: note = derived and/or modified protein sequence (wt) from HRSV__AEQ98755.1__F-del
MELPILKTNAITTILAAVTLCFASSQNITEEFYQSTCSAVSKGYLSALRTGWYTSVIAIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9629 - protein, 553 aa, synthetic construct
  REGION 1..553: note = derived and/or modified protein sequence (wt) from HRSV__AEQ98752.1__F-del
MDLPILKTNAITAILAVVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9630 - protein, 553 aa, synthetic construct
  REGION 1..553: note = derived and/or modified protein sequence (wt) from HRSV__AEQ98753.1__F-del
MELPILKTNAITTILAAVILCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9631 - protein, 553 aa, synthetic construct
  REGION 1..553: note = derived and/or modified protein sequence (wt) from HRSV__AEQ98747.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVITVILLALIAVGLLLYCKAR

SEQ ID NO: 9632 - protein, 553 aa, synthetic construct
  REGION 1..553: note = derived and/or modified protein sequence (wt) from HRSV__ASF87325.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARKELQRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9633 - protein, 553 aa, synthetic construct
  REGION 1..553: note = derived and/or modified protein sequence (wt) from HRSV__ASF87326.1__F-del
MELPILKTNAIATILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMDYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9634 - protein, 553 aa, synthetic construct
  REGION 1..553: note = derived and/or modified protein sequence (wt) from HRSV__5W23_A__F-del
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSH

SEQ ID NO: 9635 - protein, 553 aa, synthetic construct
  REGION 1..553: note = derived and/or modified protein sequence (wt) from HRSV__5EA3_F__F-del
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSH

SEQ ID NO: 9636 - protein, 553 aa, synthetic construct
  REGION 1..553: note = derived and/or modified protein sequence (wt) from HRSV__5UDD_A__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLTQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKSYINNQLLPILNQQSCRISNIETVIEFQQKNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSH

SEQ ID NO: 9637 - protein, 553 aa, synthetic construct
  REGION 1..553: note = derived and/or modified protein sequence (wt) from HRSV__5EA8_F__F-del
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFYASISQVNEKINQSLAFIRKSDELLSAIGGYIPEAPRDGQAYVRKDGEWVLLSTFLGGLVPRGSH

SEQ ID NO: 9638 - protein, 553 aa, synthetic construct
  REGION 1..553: note = derived and/or modified protein sequence (wt) from HRSV__AHG54458.1__F-del
MEFPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRQSDELLHNVNAGKSTTNIMITTIIIVIIVILLALIAVGLLLYCKAR

SEQ ID NO: 9639 - protein, 553 aa, synthetic construct
  REGION 1..553: note = derived and/or modified protein sequence (wt) from HRSV__AEN74947.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYNPLVFPSDEFDASISQVNEKINQSLAFIRRSDELLHNVNTGKSTTNIMITAIIIVIIVVLLSLIAIGLLLYCKAK

SEQ ID NO: 9640 - protein, 553 aa, synthetic construct
  REGION 1..553: note = derived and/or modified protein sequence (wt) from HRSV__AHG54485.1__F-del
MDLLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9641 - protein, 553 aa, synthetic construct
  REGION 1..553: note = derived and/or modified protein sequence (wt) from HRSV__AHG54477.1__F-del
MELPILKTNAITTILAAITLCFASSQNITEEFYQSTCSAVSKGYLSALRTGWYTSVITIELSNIKENKCNGTDAKVKLIKQELNKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9642 - protein, 553 aa, synthetic construct
  REGION 1..553: note = derived and/or modified protein sequence (wt) from HRSV__AHG54451.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALITVGLLLYCKAR

SEQ ID NO: 9643 - protein, 553 aa, synthetic construct
  REGION 1..553: note = derived and/or modified protein sequence (wt) from HRSV__AHG54463.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPNYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALITVGLLLYCKAR

SEQ ID NO: 9644 - protein, 553 aa, synthetic construct
  REGION 1..553: note = derived and/or modified protein sequence (wt) from HRSV__AHG54445.1__F-del
MELPILKTNAITTILAAVTLCFASSQNITGEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9645 - protein, 553 aa, synthetic construct
  REGION 1..553: note = derived and/or modified protein sequence (wt) from HRSV__AEO12131.1__F-del
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQTVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIDQSLAFIRKSDELLHNVNAGKSTTNIMITTIIIVIIVILLALIAVGLLLYCKAR

SEQ ID NO: 9646 - protein, 553 aa, synthetic construct
  REGION 1..553: note = derived and/or modified protein sequence (wt) from HRSV__AEN74945.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISTIETVIEFQQKNSRLLEINREFSVNAGVTTPLSTYMLTNSELLSLINDMPITNDQKKLMSSNVQIVRQQSYSIMSIIKEEVLAYVVRLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9647 - protein, 553 aa, synthetic construct
  REGION 1..553: note = derived and/or modified protein sequence (wt) from HRSV__AEN74944.1__F-del
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITRGFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLCYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9648 - protein, 553 aa, synthetic construct
  REGION 1..553: note = derived and/or modified protein sequence (wt) from HRSV__ASF87335.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELQRFTNYTLNNTKNTNVTLSKKRKRRFLGFLLGVGSAIASGIAVSKVLHLEGEVNKIKSALLSTNKAIVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIAILSALIAVGLLLYCKAR

SEQ ID NO: 9649 - protein, 553 aa, synthetic construct
  REGION 1..553: note = derived and/or modified protein sequence (wt) from HRSV__AHG54515.1__F-del
MELLIHRSSAIFLTLAINALYLTSSQNITEEFYQSTCSAVSRGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKAR

SEQ ID NO: 9650 - protein, 553 aa, synthetic construct
  REGION 1..553: note = derived and/or modified protein sequence (wt) from HRSV__AHA61605.1__F-del
MELLILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKAR

SEQ ID NO: 9651 - protein, 553 aa, synthetic construct
  REGION 1..553: note = derived and/or modified protein sequence (wt) from HRSV__AHV81660.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLSFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAR

SEQ ID NO: 9652 - protein, 553 aa, synthetic construct
  REGION 1..553: note = derived and/or modified protein sequence (wt) from HRSV__AHG54441.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSISFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAQ

SEQ ID NO: 9653 - protein, 553 aa, synthetic construct
  REGION 1..553: note = derived and/or modified protein sequence (wt) from HRSV(Memphis-37)__AIY60640.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9654 - protein, 553 aa, synthetic construct
  REGION 1..553: note = derived and/or modified protein sequence (wt) from HRSV__ABQ42594.1__F-del
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNVGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9655 - protein, 553 aa, synthetic construct
  REGION 1..553: note = derived and/or modified protein sequence (wt) from HRSV__ACO83297.1__F-del
MELPILKANAITTILAAVTFCFASSQNITEEFYQSTCSAVSKGYLSALRTGWYTSVITIELSNIKKNKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSRVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAEKCKVQSNRVFCDTMYSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9656 - protein, 553 aa, synthetic construct
  REGION 1..553: note = derived and/or modified protein sequence (wt) from HRSV__ACO83301.1__F-del
MELLILKANAITTILTAVTFCFASGQNITEEFYQSTCSAVSKGYLSALRTGWYTSVITIELSNIKKNKCNGTDAKIKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKAR

SEQ ID NO: 9657 - protein, 553 aa, synthetic construct; identical to SEQ ID NO: 9152
  REGION 1..553: note = derived and/or modified protein sequence (wt) from HRSV__ADZ95775.1__F-del

SEQ ID NO: 9658 - protein, 553 aa, synthetic construct; identical to SEQ ID NO: 9150
  REGION 1..553: note = derived and/or modified protein sequence (wt) from HRSV__ADZ95779.1__F-del

SEQ ID NO: 9659 - protein, 553 aa, synthetic construct
  REGION 1..553: note = derived and/or modified protein sequence (wt) from HRSV__AEQ63597.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKIQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9660 - protein, 553 aa, synthetic construct
  REGION 1..553: note = derived and/or modified protein sequence (wt) from HRSV__AEQ63608.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPTANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9661 - protein, 553 aa, synthetic construct
  REGION 1..553: note = derived and/or modified protein sequence (wt) from HRSV__AEQ63630.1__F-del
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNARVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAK

SEQ ID NO: 9662 - protein, 553 aa, synthetic construct
  REGION 1..553: note = derived and/or modified protein sequence (wt) from HRSV__AHE57683.1__F-del
MDLPILKTNAITAILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9663 - protein, 553 aa, synthetic construct
  REGION 1..553: note = derived and/or modified protein sequence (wt) from HRSV__AHE57894.1__F-del
MDLPILKTNAITAILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITIDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9664 - protein, 553 aa, synthetic construct
  REGION 1..553: note = derived and/or modified protein sequence (wt) from HRSV__AHW80511.1__F-del
MELPILKTNAITTILAAVTLCFASSQNITEEFYQSTCSAVSKGYLSALRTGWYTSVITIELSTIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTKIMITTIIIVIIVILLSLIAVGLLLYCKAR

SEQ ID NO: 9665 - protein, 553 aa, synthetic construct
  REGION 1..553: note = derived and/or modified protein sequence (wt) from HRSV__AHW80560.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9666 - protein, 553 aa, synthetic construct
  REGION 1..553: note = derived and/or modified protein sequence (wt) from HRSV__AHW80660.1__F-del
MDLPILKTNAITAILAAVSLCLASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9667 - protein, 553 aa, synthetic construct; identical to SEQ ID NO: 9665
  REGION 1..553: note = derived and/or modified protein sequence (wt) from HRSV__AHW80670.1__F-del

SEQ ID NO: 9668 - protein, 553 aa, synthetic construct
  REGION 1..553: note = derived and/or modified protein sequence (wt) from HRSV__AHW80760.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9669 - protein, 553 aa, synthetic construct
  REGION 1..553: note = derived and/or modified protein sequence (wt) from HRSV__AHW80800.1__F-del
MDLPILKTNAITTILAAVTLCIASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9670 - protein, 553 aa, synthetic construct
  REGION 1..553: note = derived and/or modified protein sequence (wt) from HRSV__AHW80860.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRLMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9671 - protein, 553 aa, synthetic construct
  REGION 1..553: note = derived and/or modified protein sequence (wt) from HRSV__AHW80990.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKLKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9672 - protein, 553 aa, synthetic construct
  REGION 1..553: note = derived and/or modified protein sequence (wt) from HRSV__AHW81370.1__F-del
MELPILKTNAITTILAAVALCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9673 - protein, 553 aa, synthetic construct
  REGION 1..553: note = derived and/or modified protein sequence (wt) from HRSV__AHX22013.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFIGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9674 - protein, 553 aa, synthetic construct
  REGION 1..553: note = derived and/or modified protein sequence (wt) from HRSV__AIA62675.1__F-del
MELPILKANAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFFLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9675 - protein, 553 aa, synthetic construct
  REGION 1..553: note = derived and/or modified protein sequence (wt) from HRSV__AIA62685.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFFLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9676 - protein, 553 aa, synthetic construct
  REGION 1..553: note = derived and/or modified protein sequence (wt) from HRSV__AIA63044.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSPYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9677 - protein, 553 aa, synthetic construct
  REGION 1..553: note = derived and/or modified protein sequence (wt) from HRSV__AIA63234.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFFNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9678 - protein, 553 aa, synthetic construct
  REGION 1..553: note = derived and/or modified protein sequence (wt) from HRSV__AIA63364.1__F-del
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSITDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9679 - protein, 553 aa, synthetic construct; identical to SEQ ID NO: 9653
  REGION 1..553: note = derived and/or modified protein sequence (wt) from HRSV__AIA63604.1__F-del

SEQ ID NO: 9680 - protein, 553 aa, synthetic construct
  REGION 1..553: note = derived and/or modified protein sequence (wt) from HRSV__AUH26189.1__F-del
MDLPILKTNAITAILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKRLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 9681 - protein, 553 aa, synthetic construct
  REGION 1..553: note = derived and/or modified protein sequence (wt) from HRSV__NP_044596.1__F-del
MELPILKTNAITAILAAVTLCFASSQNITEEFYQTTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKAR

SEQ ID NO: 9682 - protein, 553 aa, synthetic construct
  REGION 1..553: note = derived and/or modified protein sequence (wt) from HRSV__1701388A__F-del
MELPILKTNTITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKAR

SEQ ID NO: 9683 - protein, 553 aa, synthetic construct
  REGION 1..553: note = derived and/or modified protein sequence (wt) from HRSV__WP_079890144.1__F-del
MELLILKANAITTILTAVTFCFASGQNITEEFYQSTCSAVSKGYLSALRTGWYTSVITIELSNIKKIKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNVGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 9684 - protein, 256 aa, synthetic construct
  REGION 1..256: note = derived and/or modified protein sequence (wt) from HRSV(A2)__P0DOE7.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 9685 - RNA, 771 nt, synthetic construct
  misc_feature 1..771: note = derived and/or modified CDS sequence (wt) from HRSV(A2)__P0DOE7.1__M
  source 1..771: mol_type = other RNA
atggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaa

SEQ ID NO: 9686 - RNA, 771 nt, synthetic construct
  misc_feature 1..771: note = derived and/or modified CDS sequence (opt1) from HRSV(A2)__P0DOE7.1__M
  source 1..771: mol_type = other RNA
atggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactga

SEQ ID NO: 9687 - RNA, 771 nt, synthetic construct
  misc_feature 1..771: note = derived and/or modified CDS sequence (opt2) from HRSV(A2)__P0DOE7.1__M
  source 1..771: mol_type = other RNA
atggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactga

SEQ ID NO: 9688 - RNA, 771 nt, synthetic construct
  misc_feature 1..771: note = derived and/or modified CDS sequence (opt3) from HRSV(A2)__P0DOE7.1__M
  source 1..771: mol_type = other RNA
atggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattga

SEQ ID NO: 9689 - RNA, 771 nt, synthetic construct
  misc_feature 1..771: note = derived and/or modified CDS sequence (opt4) from HRSV(A2)__P0DOE7.1__M
  source 1..771: mol_type = other RNA
atggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactga

SEQ ID NO: 9690 - RNA, 771 nt, synthetic construct
  misc_feature 1..771: note = derived and/or modified CDS sequence (opt5) from HRSV(A2)__P0DOE7.1__M
  source 1..771: mol_type = other RNA
atggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattga

SEQ ID NO: 9691 - RNA, 771 nt, synthetic construct
  misc_feature 1..771: note = derived and/or modified CDS sequence (opt6) from HRSV(A2)__P0DOE7.1__M
  source 1..771: mol_type = other RNA
atggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaa

SEQ ID NO: 9692 - RNA, 771 nt, synthetic construct
  misc_feature 1..771: note = derived and/or modified CDS sequence (opt11) from HRSV(A2)__P0DOE7.1__M
  source 1..771: mol_type = other RNA
atggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaa

SEQ ID NO: 9693 - RNA, 1047 nt, synthetic construct
  misc_feature 1..1047: note = mRNA product Design a-1 comprising derived and/or modified sequence from HRSV(A2)__P0DOE7.1__M (wt)
  source 1..1047: mol_type = other RNA
gggagagtcccgcagtcggcgtccagcggctctgcttgttcgtgtgtgtgtcgttgcaggccttattcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9694 - RNA, 1047 nt, synthetic construct
  misc_feature 1..1047: note = mRNA product Design a-1 comprising derived and/or modified sequence from HRSV(A2)__P0DOE7.1__M (opt1)
  source 1..1047: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9695 - RNA, 1047 nt, synthetic construct
  misc_feature 1..1047: note = mRNA product Design a-1 comprising derived and/or modified sequence from HRSV(A2)__P0DOE7.1__M (opt2)
  source 1..1047: mol_type = other RNA
gggagagtcccgcagtcggcgtccagcggctctgcttgttcgtgtgtgtgtcgttgcaggccttattcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9696 - RNA, 1047 nt, synthetic construct
  misc_feature 1..1047: note = mRNA product Design a-1 comprising derived and/or modified sequence from HRSV(A2)__P0DOE7.1__M (opt3)
  source 1..1047: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9697 - RNA, 1047 nt, synthetic construct
  misc_feature 1..1047: note = mRNA product Design a-1 comprising derived and/or modified sequence from HRSV(A2)__P0DOE7.1__M (opt4)
  source 1..1047: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9698 - RNA, 1047 nt, synthetic construct
  misc_feature 1..1047: note = mRNA product Design a-1 comprising derived and/or modified sequence from HRSV(A2)__P0DOE7.1__M (opt5)
  source 1..1047: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9699 - RNA, 1047 nt, synthetic construct
  misc_feature 1..1047: note = mRNA product Design a-1 comprising derived and/or modified sequence from HRSV(A2)__P0DOE7.1__M (opt6)
  source 1..1047: mol_type = other RNA
gggagagtcccgcagtcggcgtccagcggctctgcttgttcgtgtgtgtgtcgttgcaggccttattcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9700 - RNA, 1047 nt, synthetic construct
  misc_feature 1..1047: note = mRNA product Design a-1 comprising derived and/or modified sequence from HRSV(A2)__P0DOE7.1__M (opt11)
  source 1..1047: mol_type = other RNA
gggagagtcccgcagtcggcgtccagcggctctgcttgttcgtgtgtgtgtcgttgcaggccttattcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9701 - RNA, 1066 nt, synthetic construct
  misc_feature 1..1066: note = mRNA product Design a-2 comprising derived and/or modified sequence from HRSV(A2)__P0DOE7.1__M (wt)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9702 - RNA, 1066 nt, synthetic construct
  misc_feature 1..1066: note = mRNA product Design a-2 comprising derived and/or modified sequence from HRSV(A2)__P0DOE7.1__M (opt1)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9703 - RNA, 1066 nt, synthetic construct
  misc_feature 1..1066: note = mRNA product Design a-2 comprising derived and/or modified sequence from HRSV(A2)__P0DOE7.1__M (opt2)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9704 - RNA, 1066 nt, synthetic construct
  misc_feature 1..1066: note = mRNA product Design a-2 comprising derived and/or modified sequence from HRSV(A2)__P0DOE7.1__M (opt3)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9705 - RNA, 1066 nt, synthetic construct
  misc_feature 1..1066: note = mRNA product Design a-2 comprising derived and/or modified sequence from HRSV(A2)__P0DOE7.1__M (opt4)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9706 - RNA, 1066 nt, synthetic construct
  misc_feature 1..1066: note = mRNA product Design a-2 comprising derived and/or modified sequence from HRSV(A2)__P0DOE7.1__M (opt5)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9707 - RNA, 1066 nt, synthetic construct
  misc_feature 1..1066: note = mRNA product Design a-2 comprising derived and/or modified sequence from HRSV(A2)__P0DOE7.1__M (opt6)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9708 - RNA, 1066 nt, synthetic construct
  misc_feature 1..1066: note = mRNA product Design a-2 comprising derived and/or modified sequence from HRSV(A2)__P0DOE7.1__M (opt11)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9709 - RNA, 1144 nt, synthetic construct
  misc_feature 1..1144: note = mRNA product Design a-3 comprising derived and/or modified sequence from HRSV(A2)__P0DOE7.1__M (wt)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9710 - RNA, 1144 nt, synthetic construct
  misc_feature 1..1144: note = mRNA product Design a-3 comprising derived and/or modified sequence from HRSV(A2)__P0DOE7.1__M (opt1)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9711 - RNA, 1144 nt, synthetic construct
  misc_feature 1..1144: note = mRNA product Design a-3 comprising derived and/or modified sequence from HRSV(A2)__P0DOE7.1__M (opt2)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9712 - RNA, 1144 nt, synthetic construct
  misc_feature 1..1144: note = mRNA product Design a-3 comprising derived and/or modified sequence from HRSV(A2)__P0DOE7.1__M (opt3)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9713 - RNA, 1144 nt, synthetic construct
  misc_feature 1..1144: note = mRNA product Design a-3 comprising derived and/or modified sequence from HRSV(A2)__P0DOE7.1__M (opt4)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9714 - RNA, 1144 nt, synthetic construct
  misc_feature 1..1144: note = mRNA product Design a-3 comprising derived and/or modified sequence from HRSV(A2)__P0DOE7.1__M (opt5)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9715 - RNA, 1144 nt, synthetic construct
  misc_feature 1..1144: note = mRNA product Design a-3 comprising derived and/or modified sequence from HRSV(A2)__P0DOE7.1__M (opt6)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9716 - RNA, 1144 nt, synthetic construct
  misc_feature 1..1144: note = mRNA product Design a-3 comprising derived and/or modified sequence from HRSV(A2)__P0DOE7.1__M (opt11)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9717 - RNA, 1093 nt, synthetic construct
  misc_feature 1..1093: note = mRNA product Design a-4 comprising derived and/or modified sequence from HRSV(A2)__P0DOE7.1__M (wt)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9718 - RNA, 1093 nt, synthetic construct
  misc_feature 1..1093: note = mRNA product Design a-4 comprising derived and/or modified sequence from HRSV(A2)__P0DOE7.1__M (opt1)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9719 - RNA, 1093 nt, synthetic construct
  misc_feature 1..1093: note = mRNA product Design a-4 comprising derived and/or modified sequence from HRSV(A2)__P0DOE7.1__M (opt2)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9720 - RNA, 1093 nt, synthetic construct
  misc_feature 1..1093: note = mRNA product Design a-4 comprising derived and/or modified sequence from HRSV(A2)__P0DOE7.1__M (opt3)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9721 - RNA, 1093 nt, synthetic construct
  misc_feature 1..1093: note = mRNA product Design a-4 comprising derived and/or modified sequence from HRSV(A2)__P0DOE7.1__M (opt4)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9722 - RNA, 1093 nt, synthetic construct
  misc_feature 1..1093: note = mRNA product Design a-4 comprising derived and/or modified sequence from HRSV(A2)__P0DOE7.1__M (opt5)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9723 - RNA, 1093 nt, synthetic construct
  misc_feature 1..1093: note = mRNA product Design a-4 comprising derived and/or modified sequence from HRSV(A2)__P0DOE7.1__M (opt6)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9724 - RNA, 1093 nt, synthetic construct
  misc_feature 1..1093: note = mRNA product Design a-4 comprising derived and/or modified sequence from HRSV(A2)__P0DOE7.1__M (opt11)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9725 - RNA, 1039 nt, synthetic construct
  misc_feature 1..1039: note = mRNA product Design a-5 comprising derived and/or modified sequence from HRSV(A2)__P0DOE7.1__M (wt)
  source 1..1039: mol_type = other RNA
gggagactttcccattctgtagcagaatttggtgttgcctgtggtcttggtcccgcggagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9726 - RNA, 1039 nt, synthetic construct
  misc_feature 1..1039: note = mRNA product Design a-5 comprising derived and/or modified sequence from HRSV(A2)__P0DOE7.1__M (opt1)
  source 1..1039: mol_type = other RNA
gggagactttcccattctgtagcagaatttggtgttgcctgtggtcttggtcccgcggagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9727 - RNA, 1039 nt, synthetic construct
  misc_feature 1..1039: note = mRNA product Design a-5 comprising derived and/or modified sequence from HRSV(A2)__P0DOE7.1__M (opt2)
  source 1..1039: mol_type = other RNA
gggagactttcccattctgtagcagaatttggtgttgcctgtggtcttggtcccgcggagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9728 - RNA, 1039 nt, synthetic construct
  misc_feature 1..1039: note = mRNA product Design a-5 comprising derived and/or modified sequence from HRSV(A2)__P0DOE7.1__M (opt3)
  source 1..1039: mol_type = other RNA
gggagactttcccattctgtagcagaatttggtgttgcctgtggtcttggtcccgcggagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9729 - RNA, 1039 nt, synthetic construct
  misc_feature 1..1039: note = mRNA product Design a-5 comprising derived and/or modified sequence from HRSV(A2)__P0DOE7.1__M (opt4)
  source 1..1039: mol_type = other RNA
gggagactttcccattctgtagcagaatttggtgttgcctgtggtcttggtcccgcggagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9730 - RNA, 1039 nt, synthetic construct
  misc_feature 1..1039: note = mRNA product Design a-5 comprising derived and/or modified sequence from HRSV(A2)__P0DOE7.1__M (opt5)
  source 1..1039: mol_type = other RNA
gggagactttcccattctgtagcagaatttggtgttgcctgtggtcttggtcccgcggagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9731 - RNA, 1039 nt, synthetic construct
  misc_feature 1..1039: note = mRNA product Design a-5 comprising derived and/or modified sequence from HRSV(A2)__P0DOE7.1__M (opt6)
  source 1..1039: mol_type = other RNA
gggagactttcccattctgtagcagaatttggtgttgcctgtggtcttggtcccgcggagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9732 - RNA, 1039 nt, synthetic construct
  misc_feature 1..1039: note = mRNA product Design a-5 comprising derived and/or modified sequence from HRSV(A2)__P0DOE7.1__M (opt11)
  source 1..1039: mol_type = other RNA
gggagactttcccattctgtagcagaatttggtgttgcctgtggtcttggtcccgcggagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9733 - RNA, 1220 nt, synthetic construct
  misc_feature 1..1220: note = mRNA product Design b-1 comprising derived and/or modified sequence from HRSV(A2)__P0DOE7.1__M (wt)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9734 - RNA, 1220 nt, synthetic construct
  misc_feature 1..1220: note = mRNA product Design b-1 comprising derived and/or modified sequence from HRSV(A2)__P0DOE7.1__M (opt1)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9735 - RNA, 1220 nt, synthetic construct
  misc_feature 1..1220: note = mRNA product Design b-1 comprising derived and/or modified sequence from HRSV(A2)__P0DOE7.1__M (opt2)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9736 - RNA, 1220 nt, synthetic construct
  misc_feature 1..1220: note = mRNA product Design b-1 comprising derived and/or modified sequence from HRSV(A2)__P0DOE7.1__M (opt3)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9737 - RNA, 1220 nt, synthetic construct
  misc_feature 1..1220: note = mRNA product Design b-1 comprising derived and/or modified sequence from HRSV(A2)__P0DOE7.1__M (opt4)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9738 - RNA, 1220 nt, synthetic construct
  misc_feature 1..1220: note = mRNA product Design b-1 comprising derived and/or modified sequence from HRSV(A2)__P0DOE7.1__M (opt5)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9739 - RNA, 1220 nt, synthetic construct
  misc_feature 1..1220: note = mRNA product Design b-1 comprising derived and/or modified sequence from HRSV(A2)__P0DOE7.1__M (opt6)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9740 - RNA, 1220 nt, synthetic construct
  misc_feature 1..1220: note = mRNA product Design b-1 comprising derived and/or modified sequence from HRSV(A2)__P0DOE7.1__M (opt11)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9741 - RNA, 1040 nt, synthetic construct
  misc_feature 1..1040: note = mRNA product Design b-2 comprising derived and/or modified sequence from HRSV(A2)__P0DOE7.1__M (wt)
  source 1..1040: mol_type = other RNA
gggagagcctctgctggagtccggggagtggcgttggctgctagagcgaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9742 - RNA, 1040 nt, synthetic construct
  misc_feature 1..1040: note = mRNA product Design b-2 comprising derived and/or modified sequence from HRSV(A2)__P0DOE7.1__M (opt1)
  source 1..1040: mol_type = other RNA
gggagagcctctgctggagtccggggagtggcgttggctgctagagcgaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9743 - RNA, 1040 nt, synthetic construct
  misc_feature 1..1040: note = mRNA product Design b-2 comprising derived and/or modified sequence from HRSV(A2)__P0DOE7.1__M (opt2)
  source 1..1040: mol_type = other RNA
gggagagcctctgctggagtccggggagtggcgttggctgctagagcgaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9744 - RNA, 1040 nt, synthetic construct
  misc_feature 1..1040: note = mRNA product Design b-2 comprising derived and/or modified sequence from HRSV(A2)__P0DOE7.1__M (opt3)
  source 1..1040: mol_type = other RNA
gggagagcctctgctggagtccggggagtggcgttggctgctagagcgaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9745 - RNA, 1040 nt, synthetic construct
  misc_feature 1..1040: note = mRNA product Design b-2 comprising derived and/or modified sequence from HRSV(A2)__P0DOE7.1__M (opt4)
  source 1..1040: mol_type = other RNA
gggagagcctctgctggagtccggggagtggcgttggctgctagagcgaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9746 - RNA, 1040 nt, synthetic construct
  misc_feature 1..1040: note = mRNA product Design b-2 comprising derived and/or modified sequence from HRSV(A2)__P0DOE7.1__M (opt5)
  source 1..1040: mol_type = other RNA
gggagagcctctgctggagtccggggagtggcgttggctgctagagcgaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9747 - RNA, 1040 nt, synthetic construct
  misc_feature 1..1040: note = mRNA product Design b-2 comprising derived and/or modified sequence from HRSV(A2)__P0DOE7.1__M (opt6)
  source 1..1040: mol_type = other RNA
gggagagcctctgctggagtccggggagtggcgttggctgctagagcgaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9748 - RNA, 1040 nt, synthetic construct
  misc_feature 1..1040: note = mRNA product Design b-2 comprising derived and/or modified sequence from HRSV(A2)__P0DOE7.1__M (opt11)
  source 1..1040: mol_type = other RNA
gggagagcctctgctggagtccggggagtggcgttggctgctagagcgaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9749 - RNA, 1060 nt, synthetic construct
  misc_feature 1..1060: note = mRNA product Design b-3 comprising derived and/or modified sequence from HRSV(A2)__P0DOE7.1__M (wt)
  source 1..1060: mol_type = other RNA
gggagagtcccgcagtcggcgtccagcggctctgcttgttcgtgtgtgtgtcgttgcaggccttattcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9750 - RNA, 1060 nt, synthetic construct
  misc_feature 1..1060: note = mRNA product Design b-3 comprising derived and/or modified sequence from HRSV(A2)__P0DOE7.1__M (opt1)
  source 1..1060: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9751 - RNA, 1060 nt, synthetic construct
  misc_feature 1..1060: note = mRNA product Design b-3 comprising derived and/or modified sequence from HRSV(A2)__P0DOE7.1__M (opt2)
  source 1..1060: mol_type = other RNA
gggagagtcccgcagtcggcgtccagcggctctgcttgttcgtgtgtgtgtcgttgcaggccttattcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9752 - RNA, 1060 nt, synthetic construct
  misc_feature 1..1060: note = mRNA product Design b-3 comprising derived and/or modified sequence from HRSV(A2)__P0DOE7.1__M (opt3)
  source 1..1060: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9753 - RNA, 1060 nt, synthetic construct
  misc_feature 1..1060: note = mRNA product Design b-3 comprising derived and/or modified sequence from HRSV(A2)__P0DOE7.1__M (opt4)
  source 1..1060: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9754 - RNA, 1060 nt, synthetic construct
  misc_feature 1..1060: note = mRNA product Design b-3 comprising derived and/or modified sequence from HRSV(A2)__P0DOE7.1__M (opt5)
  source 1..1060: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9755 - RNA, 1060 nt, synthetic construct
  misc_feature 1..1060: note = mRNA product Design b-3 comprising derived and/or modified sequence from HRSV(A2)__P0DOE7.1__M (opt6)
  source 1..1060: mol_type = other RNA
gggagagtcccgcagtcggcgtccagcggctctgcttgttcgtgtgtgtgtcgttgcaggccttattcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9756 - RNA, 1060 nt, synthetic construct
  misc_feature 1..1060: note = mRNA product Design b-3 comprising derived and/or modified sequence from HRSV(A2)__P0DOE7.1__M (opt11)
  source 1..1060: mol_type = other RNA
gggagagtcccgcagtcggcgtccagcggctctgcttgttcgtgtgtgtgtcgttgcaggccttattcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9757 - RNA, 1111 nt, synthetic construct
  misc_feature 1..1111: note = mRNA product Design b-4 comprising derived and/or modified sequence from HRSV(A2)__P0DOE7.1__M (wt)
  source 1..1111: mol_type = other RNA
gggagagtcccgcagtcggcgtccagcggctctgcttgttcgtgtgtgtgtcgttgcaggccttattcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9758 - RNA, 1111 nt, synthetic construct
  misc_feature 1..1111: note = mRNA product Design b-4 comprising derived and/or modified sequence from HRSV(A2)__P0DOE7.1__M (opt1)
  source 1..1111: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9759 - RNA, 1111 nt, synthetic construct
  misc_feature 1..1111: note = mRNA product Design b-4 comprising derived and/or modified sequence from HRSV(A2)__P0DOE7.1__M (opt2)
  source 1..1111: mol_type = other RNA
gggagagtcccgcagtcggcgtccagcggctctgcttgttcgtgtgtgtgtcgttgcaggccttattcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9760 - RNA, 1111 nt, synthetic construct
  misc_feature 1..1111: note = mRNA product Design b-4 comprising derived and/or modified sequence from HRSV(A2)__P0DOE7.1__M (opt3)
  source 1..1111: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9761 - RNA, 1111 nt, synthetic construct
  misc_feature 1..1111: note = mRNA product Design b-4 comprising derived and/or modified sequence from HRSV(A2)__P0DOE7.1__M (opt4)
  source 1..1111: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9762 - RNA, 1111 nt, synthetic construct
  misc_feature 1..1111: note = mRNA product Design b-4 comprising derived and/or modified sequence from HRSV(A2)__P0DOE7.1__M (opt5)
  source 1..1111: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9763 - RNA, 1111 nt, synthetic construct
  misc_feature 1..1111: note = mRNA product Design b-4 comprising derived and/or modified sequence from HRSV(A2)__P0DOE7.1__M (opt6)
  source 1..1111: mol_type = other RNA
gggagagtcccgcagtcggcgtccagcggctctgcttgttcgtgtgtgtgtcgttgcaggccttattcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9764 - RNA, 1111 nt, synthetic construct
  misc_feature 1..1111: note = mRNA product Design b-4 comprising derived and/or modified sequence from HRSV(A2)__P0DOE7.1__M (opt11)
  source 1..1111: mol_type = other RNA
gggagagtcccgcagtcggcgtccagcggctctgcttgttcgtgtgtgtgtcgttgcaggccttattcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9765 - RNA, 1173 nt, synthetic construct
  misc_feature 1..1173: note = mRNA product Design b-5 comprising derived and/or modified sequence from HRSV(A2)__P0DOE7.1__M (wt)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9766 - RNA, 1173 nt, synthetic construct
  misc_feature 1..1173: note = mRNA product Design b-5 comprising derived and/or modified sequence from HRSV(A2)__P0DOE7.1__M (opt1)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9767 - RNA, 1173 nt, synthetic construct
  misc_feature 1..1173: note = mRNA product Design b-5 comprising derived and/or modified sequence from HRSV(A2)__P0DOE7.1__M (opt2)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9768 - RNA, 1173 nt, synthetic construct
  misc_feature 1..1173: note = mRNA product Design b-5 comprising derived and/or modified sequence from HRSV(A2)__P0DOE7.1__M (opt3)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9769 - RNA, 1173 nt, synthetic construct
  misc_feature 1..1173: note = mRNA product Design b-5 comprising derived and/or modified sequence from HRSV(A2)__P0DOE7.1__M (opt4)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9770 - RNA, 1173 nt, synthetic construct
  misc_feature 1..1173: note = mRNA product Design b-5 comprising derived and/or modified sequence from HRSV(A2)__P0DOE7.1__M (opt5)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9771 - RNA, 1173 nt, synthetic construct
  misc_feature 1..1173: note = mRNA product Design b-5 comprising derived and/or modified sequence from HRSV(A2)__P0DOE7.1__M (opt6)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9772 - RNA, 1173 nt, synthetic construct
  misc_feature 1..1173: note = mRNA product Design b-5 comprising derived and/or modified sequence from HRSV(A2)__P0DOE7.1__M (opt11)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9773 - RNA, 1079 nt, synthetic construct
  misc_feature 1..1079: note = mRNA product Design c-1 comprising derived and/or modified sequence from HRSV(A2)__P0DOE7.1__M (wt)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9774 - RNA, 1079 nt, synthetic construct
  misc_feature 1..1079: note = mRNA product Design c-1 comprising derived and/or modified sequence from HRSV(A2)__P0DOE7.1__M (opt1)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9775 - RNA, 1079 nt, synthetic construct
  misc_feature 1..1079: note = mRNA product Design c-1 comprising derived and/or modified sequence from HRSV(A2)__P0DOE7.1__M (opt2)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9776 - RNA, 1079 nt, synthetic construct
  misc_feature 1..1079: note = mRNA product Design c-1 comprising derived and/or modified sequence from HRSV(A2)__P0DOE7.1__M (opt3)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9777 - RNA, 1079 nt, synthetic construct
  misc_feature 1..1079: note = mRNA product Design c-1 comprising derived and/or modified sequence from HRSV(A2)__P0DOE7.1__M (opt4)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9778 - RNA, 1079 nt, synthetic construct
  misc_feature 1..1079: note = mRNA product Design c-1 comprising derived and/or modified sequence from HRSV(A2)__P0DOE7.1__M (opt5)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9779 - RNA, 1079 nt, synthetic construct
  misc_feature 1..1079: note = mRNA product Design c-1 comprising derived and/or modified sequence from HRSV(A2)__P0DOE7.1__M (opt6)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9780 - RNA, 1079 nt, synthetic construct
  misc_feature 1..1079: note = mRNA product Design c-1 comprising derived and/or modified sequence from HRSV(A2)__P0DOE7.1__M (opt11)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9781 - RNA, 1169 nt, synthetic construct
  misc_feature 1..1169: note = mRNA product Design c-2 comprising derived and/or modified sequence from HRSV(A2)__P0DOE7.1__M (wt)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9782 - RNA, 1169 nt, synthetic construct
  misc_feature 1..1169: note = mRNA product Design c-2 comprising derived and/or modified sequence from HRSV(A2)__P0DOE7.1__M (opt1)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9783 - RNA, 1169 nt, synthetic construct
  misc_feature 1..1169: note = mRNA product Design c-2 comprising derived and/or modified sequence from HRSV(A2)__P0DOE7.1__M (opt2)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9784 - RNA, 1169 nt, synthetic construct
  misc_feature 1..1169: note = mRNA product Design c-2 comprising derived and/or modified sequence from HRSV(A2)__P0DOE7.1__M (opt3)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9785 - RNA, 1169 nt, synthetic construct
  misc_feature 1..1169: note = mRNA product Design c-2 comprising derived and/or modified sequence from HRSV(A2)__P0DOE7.1__M (opt4)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9786 - RNA, 1169 nt, synthetic construct
  misc_feature 1..1169: note = mRNA product Design c-2 comprising derived and/or modified sequence from HRSV(A2)__P0DOE7.1__M (opt5)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9787 - RNA, 1169 nt, synthetic construct
  misc_feature 1..1169: note = mRNA product Design c-2 comprising derived and/or modified sequence from HRSV(A2)__P0DOE7.1__M (opt6)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9788 - RNA, 1169 nt, synthetic construct
  misc_feature 1..1169: note = mRNA product Design c-2 comprising derived and/or modified sequence from HRSV(A2)__P0DOE7.1__M (opt11)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9789 - RNA, 1146 nt, synthetic construct
  misc_feature 1..1146: note = mRNA product Design c-3 comprising derived and/or modified sequence from HRSV(A2)__P0DOE7.1__M (wt)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9790 - RNA, 1146 nt, synthetic construct
  misc_feature 1..1146: note = mRNA product Design c-3 comprising derived and/or modified sequence from HRSV(A2)__P0DOE7.1__M (opt1)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9791 - RNA, 1146 nt, synthetic construct
  misc_feature 1..1146: note = mRNA product Design c-3 comprising derived and/or modified sequence from HRSV(A2)__P0DOE7.1__M (opt2)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9792 - RNA, 1146 nt, synthetic construct
  misc_feature 1..1146: note = mRNA product Design c-3 comprising derived and/or modified sequence from HRSV(A2)__P0DOE7.1__M (opt3)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9793 - RNA, 1146 nt, synthetic construct
  misc_feature 1..1146: note = mRNA product Design c-3 comprising derived and/or modified sequence from HRSV(A2)__P0DOE7.1__M (opt4)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9794 - RNA, 1146 nt, synthetic construct
  misc_feature 1..1146: note = mRNA product Design c-3 comprising derived and/or modified sequence from HRSV(A2)__P0DOE7.1__M (opt5)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9795 - RNA, 1146 nt, synthetic construct
  misc_feature 1..1146: note = mRNA product Design c-3 comprising derived and/or modified sequence from HRSV(A2)__P0DOE7.1__M (opt6)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9796 - RNA, 1146 nt, synthetic construct
  misc_feature 1..1146: note = mRNA product Design c-3 comprising derived and/or modified sequence from HRSV(A2)__P0DOE7.1__M (opt11)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9797 - RNA, 1142 nt, synthetic construct
  misc_feature 1..1142: note = mRNA product Design c-4 comprising derived and/or modified sequence from HRSV(A2)__P0DOE7.1__M (wt)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9798 - RNA, 1142 nt, synthetic construct
  misc_feature 1..1142: note = mRNA product Design c-4 comprising derived and/or modified sequence from HRSV(A2)__P0DOE7.1__M (opt1)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9799 - RNA, 1142 nt, synthetic construct
  misc_feature 1..1142: note = mRNA product Design c-4 comprising derived and/or modified sequence from HRSV(A2)__P0DOE7.1__M (opt2)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9800 - RNA, 1142 nt, synthetic construct
  misc_feature 1..1142: note = mRNA product Design c-4 comprising derived and/or modified sequence from HRSV(A2)__P0DOE7.1__M (opt3)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9801 - RNA, 1142 nt, synthetic construct
  misc_feature 1..1142: note = mRNA product Design c-4 comprising derived and/or modified sequence from HRSV(A2)__P0DOE7.1__M (opt4)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9802 - RNA, 1142 nt, synthetic construct
  misc_feature 1..1142: note = mRNA product Design c-4 comprising derived and/or modified sequence from HRSV(A2)__P0DOE7.1__M (opt5)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9803 - RNA, 1142 nt, synthetic construct
  misc_feature 1..1142: note = mRNA product Design c-4 comprising derived and/or modified sequence from HRSV(A2)__P0DOE7.1__M (opt6)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9804 - RNA, 1142 nt, synthetic construct
  misc_feature 1..1142: note = mRNA product Design c-4 comprising derived and/or modified sequence from HRSV(A2)__P0DOE7.1__M (opt11)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9805 - RNA, 1060 nt, synthetic construct
  misc_feature 1..1060: note = mRNA product Design c-5 comprising derived and/or modified sequence from HRSV(A2)__P0DOE7.1__M (wt)
  source 1..1060: mol_type = other RNA
gggagagcggctcggccattttgtcccagtcagtccggaggctgcggctgcagaagtaccgcctgcggagtaactgcaaagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9806 - RNA, 1060 nt, synthetic construct
  misc_feature 1..1060: note = mRNA product Design c-5 comprising derived and/or modified sequence from HRSV(A2)__P0DOE7.1__M (opt1)
  source 1..1060: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9807 - RNA, 1060 nt, synthetic construct
  misc_feature 1..1060: note = mRNA product Design c-5 comprising derived and/or modified sequence from HRSV(A2)__P0DOE7.1__M (opt2)
  source 1..1060: mol_type = other RNA
gggagagcggctcggccattttgtcccagtcagtccggaggctgcggctgcagaagtaccgcctgcggagtaactgcaaagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9808 - RNA, 1060 nt, synthetic construct
  misc_feature 1..1060: note = mRNA product Design c-5 comprising derived and/or modified sequence from HRSV(A2)__P0DOE7.1__M (opt3)
  source 1..1060: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9809 - RNA, 1060 nt, synthetic construct
  misc_feature 1..1060: note = mRNA product Design c-5 comprising derived and/or modified sequence from HRSV(A2)__P0DOE7.1__M (opt4)
  source 1..1060: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9810 - RNA, 1060 nt, synthetic construct
  misc_feature 1..1060: note = mRNA product Design c-5 comprising derived and/or modified sequence from HRSV(A2)__P0DOE7.1__M (opt5)
  source 1..1060: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9811 - RNA, 1060 nt, synthetic construct
  misc_feature 1..1060: note = mRNA product Design c-5 comprising derived and/or modified sequence from HRSV(A2)__P0DOE7.1__M (opt6)
  source 1..1060: mol_type = other RNA
gggagagcggctcggccattttgtcccagtcagtccggaggctgcggctgcagaagtaccgcctgcggagtaactgcaaagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9812 - RNA, 1060 nt, synthetic construct
  misc_feature 1..1060: note = mRNA product Design c-5 comprising derived and/or modified sequence from HRSV(A2)__P0DOE7.1__M (opt11)
  source 1..1060: mol_type = other RNA
gggagagcggctcggccattttgtcccagtcagtccggaggctgcggctgcagaagtaccgcctgcggagtaactgcaaagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9813 - RNA, 1069 nt, synthetic construct
  misc_feature 1..1069: note = mRNA product Design d-1 comprising derived and/or modified sequence from HRSV(A2)__P0DOE7.1__M (wt)
  source 1..1069: mol_type = other RNA
gggagacccgtgacccggaagttgtacggctacgcgactttccctcccacaaaccctcgcgcccttcctttcctacttgggcccggcagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9814 - RNA, 1069 nt, synthetic construct
  misc_feature 1..1069: note = mRNA product Design d-1 comprising derived and/or modified sequence from HRSV(A2)__P0DOE7.1__M (opt1)
  source 1..1069: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9815 - RNA, 1069 nt, synthetic construct
  misc_feature 1..1069: note = mRNA product Design d-1 comprising derived and/or modified sequence from HRSV(A2)__P0DOE7.1__M (opt2)
  source 1..1069: mol_type = other RNA
gggagacccgtgacccggaagttgtacggctacgcgactttccctcccacaaaccctcgcgcccttcctttcctacttgggcccggcagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9816 - RNA, 1069 nt, synthetic construct
  misc_feature 1..1069: note = mRNA product Design d-1 comprising derived and/or modified sequence from HRSV(A2)__P0DOE7.1__M (opt3)
  source 1..1069: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9817 - RNA, 1069 nt, synthetic construct
  misc_feature 1..1069: note = mRNA product Design d-1 comprising derived and/or modified sequence from HRSV(A2)__P0DOE7.1__M (opt4)
  source 1..1069: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9818 - RNA, 1069 nt, synthetic construct
  misc_feature 1..1069: note = mRNA product Design d-1 comprising derived and/or modified sequence from HRSV(A2)__P0DOE7.1__M (opt5)
  source 1..1069: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9819 - RNA, 1069 nt, synthetic construct
  misc_feature 1..1069: note = mRNA product Design d-1 comprising derived and/or modified sequence from HRSV(A2)__P0DOE7.1__M (opt6)
  source 1..1069: mol_type = other RNA
gggagacccgtgacccggaagttgtacggctacgcgactttccctcccacaaaccctcgcgcccttcctttcctacttgggcccggcagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9820 - RNA, 1069 nt, synthetic construct
  misc_feature 1..1069: note = mRNA product Design d-1 comprising derived and/or modified sequence from HRSV(A2)__P0DOE7.1__M (opt11)
  source 1..1069: mol_type = other RNA
gggagacccgtgacccggaagttgtacggctacgcgactttccctcccacaaaccctcgcgcccttcctttcctacttgggcccggcagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9821 - RNA, 1124 nt, synthetic construct
  misc_feature 1..1124: note = mRNA product Design d-2 comprising derived and/or modified sequence from HRSV(A2)__P0DOE7.1__M (wt)
  source 1..1124: mol_type = other RNA
gggagagcggctcggccattttgtcccagtcagtccggaggctgcggctgcagaagtaccgcctgcggagtaactgcaaagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9822 - RNA, 1124 nt, synthetic construct
  misc_feature 1..1124: note = mRNA product Design d-2 comprising derived and/or modified sequence from HRSV(A2)__P0DOE7.1__M (opt1)
  source 1..1124: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9823 - RNA, 1124 nt, synthetic construct
  misc_feature 1..1124: note = mRNA product Design d-2 comprising derived and/or modified sequence from HRSV(A2)__P0DOE7.1__M (opt2)
  source 1..1124: mol_type = other RNA
gggagagcggctcggccattttgtcccagtcagtccggaggctgcggctgcagaagtaccgcctgcggagtaactgcaaagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9824 - RNA, 1124 nt, synthetic construct
  misc_feature 1..1124: note = mRNA product Design d-2 comprising derived and/or modified sequence from HRSV(A2)__P0DOE7.1__M (opt3)
  source 1..1124: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9825 - RNA, 1124 nt, synthetic construct
  misc_feature 1..1124: note = mRNA product Design d-2 comprising derived and/or modified sequence from HRSV(A2)__P0DOE7.1__M (opt4)
  source 1..1124: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9826 - RNA, 1124 nt, synthetic construct
  misc_feature 1..1124: note = mRNA product Design d-2 comprising derived and/or modified sequence from HRSV(A2)__P0DOE7.1__M (opt5)
  source 1..1124: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9827 - RNA, 1124 nt, synthetic construct
  misc_feature 1..1124: note = mRNA product Design d-2 comprising derived and/or modified sequence from HRSV(A2)__P0DOE7.1__M (opt6)
  source 1..1124: mol_type = other RNA
gggagagcggctcggccattttgtcccagtcagtccggaggctgcggctgcagaagtaccgcctgcggagtaactgcaaagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9828 - RNA, 1124 nt, synthetic construct
  misc_feature 1..1124: note = mRNA product Design d-2 comprising derived and/or modified sequence from HRSV(A2)__P0DOE7.1__M (opt11)
  source 1..1124: mol_type = other RNA
gggagagcggctcggccattttgtcccagtcagtccggaggctgcggctgcagaagtaccgcctgcggagtaactgcaaagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9829 - RNA, 1440 nt, synthetic construct
  misc_feature 1..1440: note = mRNA product Design d-3 comprising derived and/or modified sequence from HRSV(A2)__P0DOE7.1__M (wt)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9830 - RNA, 1440 nt, synthetic construct
  misc_feature 1..1440: note = mRNA product Design d-3 comprising derived and/or modified sequence from HRSV(A2)__P0DOE7.1__M (opt1)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9831 - RNA, 1440 nt, synthetic construct
  misc_feature 1..1440: note = mRNA product Design d-3 comprising derived and/or modified sequence from HRSV(A2)__P0DOE7.1__M (opt2)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9832 - RNA, 1440 nt, synthetic construct
  misc_feature 1..1440: note = mRNA product Design d-3 comprising derived and/or modified sequence from HRSV(A2)__P0DOE7.1__M (opt3)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9833 - RNA, 1440 nt, synthetic construct
  misc_feature 1..1440: note = mRNA product Design d-3 comprising derived and/or modified sequence from HRSV(A2)__P0DOE7.1__M (opt4)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9834 - RNA, 1440 nt, synthetic construct
  misc_feature 1..1440: note = mRNA product Design d-3 comprising derived and/or modified sequence from HRSV(A2)__P0DOE7.1__M (opt5)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9835 - RNA, 1440 nt, synthetic construct
  misc_feature 1..1440: note = mRNA product Design d-3 comprising derived and/or modified sequence from HRSV(A2)__P0DOE7.1__M (opt6)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9836 - RNA, 1440 nt, synthetic construct
  misc_feature 1..1440: note = mRNA product Design d-3 comprising derived and/or modified sequence from HRSV(A2)__P0DOE7.1__M (opt11)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9837 - RNA, 1123 nt, synthetic construct
  misc_feature 1..1123: note = mRNA product Design d-4 comprising derived and/or modified sequence from HRSV(A2)__P0DOE7.1__M (wt)
  source 1..1123: mol_type = other RNA
gggagagtcccgcagtcggcgtccagcggctctgcttgttcgtgtgtgtgtcgttgcaggccttattcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9838 - RNA, 1123 nt, synthetic construct
  misc_feature 1..1123: note = mRNA product Design d-4 comprising derived and/or modified sequence from HRSV(A2)__P0DOE7.1__M (opt1)
  source 1..1123: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9839 - RNA, 1123 nt, synthetic construct
  misc_feature 1..1123: note = mRNA product Design d-4 comprising derived and/or modified sequence from HRSV(A2)__P0DOE7.1__M (opt2)
  source 1..1123: mol_type = other RNA
gggagagtcccgcagtcggcgtccagcggctctgcttgttcgtgtgtgtgtcgttgcaggccttattcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9840 - RNA, 1123 nt, synthetic construct
  misc_feature 1..1123: note = mRNA product Design d-4 comprising derived and/or modified sequence from HRSV(A2)__P0DOE7.1__M (opt3)
  source 1..1123: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9841 - RNA, 1123 nt, synthetic construct
  misc_feature 1..1123: note = mRNA product Design d-4 comprising derived and/or modified sequence from HRSV(A2)__P0DOE7.1__M (opt4)
  source 1..1123: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9842 - RNA, 1123 nt, synthetic construct
  misc_feature 1..1123: note = mRNA product Design d-4 comprising derived and/or modified sequence from HRSV(A2)__P0DOE7.1__M (opt5)
  source 1..1123: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9843 - RNA, 1123 nt, synthetic construct
  misc_feature 1..1123: note = mRNA product Design d-4 comprising derived and/or modified sequence from HRSV(A2)__P0DOE7.1__M (opt6)
  source 1..1123: mol_type = other RNA
gggagagtcccgcagtcggcgtccagcggctctgcttgttcgtgtgtgtgtcgttgcaggccttattcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9844 - RNA, 1123 nt, synthetic construct
  misc_feature 1..1123: note = mRNA product Design d-4 comprising derived and/or modified sequence from HRSV(A2)__P0DOE7.1__M (opt11)
  source 1..1123: mol_type = other RNA
gggagagtcccgcagtcggcgtccagcggctctgcttgttcgtgtgtgtgtcgttgcaggccttattcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9845 - RNA, 1220 nt, synthetic construct
  misc_feature 1..1220: note = mRNA product Design d-5 comprising derived and/or modified sequence from HRSV(A2)__P0DOE7.1__M (wt)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9846 - RNA, 1220 nt, synthetic construct
  misc_feature 1..1220: note = mRNA product Design d-5 comprising derived and/or modified sequence from HRSV(A2)__P0DOE7.1__M (opt1)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9847 - RNA, 1220 nt, synthetic construct
  misc_feature 1..1220: note = mRNA product Design d-5 comprising derived and/or modified sequence from HRSV(A2)__P0DOE7.1__M (opt2)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9848 - RNA, 1220 nt, synthetic construct
  misc_feature 1..1220: note = mRNA product Design d-5 comprising derived and/or modified sequence from HRSV(A2)__P0DOE7.1__M (opt3)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9849 - RNA, 1220 nt, synthetic construct
  misc_feature 1..1220: note = mRNA product Design d-5 comprising derived and/or modified sequence from HRSV(A2)__P0DOE7.1__M (opt4)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9850 - RNA, 1220 nt, synthetic construct
  misc_feature 1..1220: note = mRNA product Design d-5 comprising derived and/or modified sequence from HRSV(A2)__P0DOE7.1__M (opt5)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9851 - RNA, 1220 nt, synthetic construct
  misc_feature 1..1220: note = mRNA product Design d-5 comprising derived and/or modified sequence from HRSV(A2)__P0DOE7.1__M (opt6)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9852 - RNA, 1220 nt, synthetic construct
  misc_feature 1..1220: note = mRNA product Design d-5 comprising derived and/or modified sequence from HRSV(A2)__P0DOE7.1__M (opt11)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9853 - RNA, 1100 nt, synthetic construct
  misc_feature 1..1100: note = mRNA product Design e-1 comprising derived and/or modified sequence from HRSV(A2)__P0DOE7.1__M (wt)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9854 - RNA, 1100 nt, synthetic construct
  misc_feature 1..1100: note = mRNA product Design e-1 comprising derived and/or modified sequence from HRSV(A2)__P0DOE7.1__M (opt1)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9855 - RNA, 1100 nt, synthetic construct
  misc_feature 1..1100: note = mRNA product Design e-1 comprising derived and/or modified sequence from HRSV(A2)__P0DOE7.1__M (opt2)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9856 - RNA, 1100 nt, synthetic construct
  misc_feature 1..1100: note = mRNA product Design e-1 comprising derived and/or modified sequence from HRSV(A2)__P0DOE7.1__M (opt3)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9857 - RNA, 1100 nt, synthetic construct
  misc_feature 1..1100: note = mRNA product Design e-1 comprising derived and/or modified sequence from HRSV(A2)__P0DOE7.1__M (opt4)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9858 - RNA, 1100 nt, synthetic construct
  misc_feature 1..1100: note = mRNA product Design e-1 comprising derived and/or modified sequence from HRSV(A2)__P0DOE7.1__M (opt5)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9859 - RNA, 1100 nt, synthetic construct
  misc_feature 1..1100: note = mRNA product Design e-1 comprising derived and/or modified sequence from HRSV(A2)__P0DOE7.1__M (opt6)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9860 - RNA, 1100 nt, synthetic construct
  misc_feature 1..1100: note = mRNA product Design e-1 comprising derived and/or modified sequence from HRSV(A2)__P0DOE7.1__M (opt11)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9861 - RNA, 1082 nt, synthetic construct
  misc_feature 1..1082: note = mRNA product Design e-2 comprising derived and/or modified sequence from HRSV(A2)__P0DOE7.1__M (wt)
  source 1..1082: mol_type = other RNA
gggagacccgtgacccggaagttgtacggctacgcgactttccctcccacaaaccctcgcgcccttcctttcctacttgggcccggcagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9862 - RNA, 1082 nt, synthetic construct
  misc_feature 1..1082: note = mRNA product Design e-2 comprising derived and/or modified sequence from HRSV(A2)__P0DOE7.1__M (opt1)
  source 1..1082: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9863 - RNA, 1082 nt, synthetic construct
  misc_feature 1..1082: note = mRNA product Design e-2 comprising derived and/or modified sequence from HRSV(A2)__P0DOE7.1__M (opt2)
  source 1..1082: mol_type = other RNA
gggagacccgtgacccggaagttgtacggctacgcgactttccctcccacaaaccctcgcgcccttcctttcctacttgggcccggcagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9864 - RNA, 1082 nt, synthetic construct
  misc_feature 1..1082: note = mRNA product Design e-2 comprising derived and/or modified sequence from HRSV(A2)__P0DOE7.1__M (opt3)
  source 1..1082: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9865 - RNA, 1082 nt, synthetic construct
  misc_feature 1..1082: note = mRNA product Design e-2 comprising derived and/or modified sequence from HRSV(A2)__P0DOE7.1__M (opt4)
  source 1..1082: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9866 - RNA, 1082 nt, synthetic construct
  misc_feature 1..1082: note = mRNA product Design e-2 comprising derived and/or modified sequence from HRSV(A2)__P0DOE7.1__M (opt5)
  source 1..1082: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9867 - RNA, 1082 nt, synthetic construct
  misc_feature 1..1082: note = mRNA product Design e-2 comprising derived and/or modified sequence from HRSV(A2)__P0DOE7.1__M (opt6)
  source 1..1082: mol_type = other RNA
gggagacccgtgacccggaagttgtacggctacgcgactttccctcccacaaaccctcgcgcccttcctttcctacttgggcccggcagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9868 - RNA, 1082 nt, synthetic construct
  misc_feature 1..1082: note = mRNA product Design e-2 comprising derived and/or modified sequence from HRSV(A2)__P0DOE7.1__M (opt11)
  source 1..1082: mol_type = other RNA
gggagacccgtgacccggaagttgtacggctacgcgactttccctcccacaaaccctcgcgcccttcctttcctacttgggcccggcagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9869 - RNA, 1052 nt, synthetic construct
  misc_feature 1..1052: note = mRNA product Design e-3 comprising derived and/or modified sequence from HRSV(A2)__P0DOE7.1__M (wt)
  source 1..1052: mol_type = other RNA
gggagactttcccattctgtagcagaatttggtgttgcctgtggtcttggtcccgcggagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9870 - RNA, 1052 nt, synthetic construct
  misc_feature 1..1052: note = mRNA product Design e-3 comprising derived and/or modified sequence from HRSV(A2)__P0DOE7.1__M (opt1)
  source 1..1052: mol_type = other RNA
gggagactttcccattctgtagcagaatttggtgttgcctgtggtcttggtcccgcggagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9871 - RNA, 1052 nt, synthetic construct
  misc_feature 1..1052: note = mRNA product Design e-3 comprising derived and/or modified sequence from HRSV(A2)__P0DOE7.1__M (opt2)
  source 1..1052: mol_type = other RNA
gggagactttcccattctgtagcagaatttggtgttgcctgtggtcttggtcccgcggagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9872 - RNA, 1052 nt, synthetic construct
  misc_feature 1..1052: note = mRNA product Design e-3 comprising derived and/or modified sequence from HRSV(A2)__P0DOE7.1__M (opt3)
  source 1..1052: mol_type = other RNA
gggagactttcccattctgtagcagaatttggtgttgcctgtggtcttggtcccgcggagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9873 - RNA, 1052 nt, synthetic construct
  misc_feature 1..1052: note = mRNA product Design e-3 comprising derived and/or modified sequence from HRSV(A2)__P0DOE7.1__M (opt4)
  source 1..1052: mol_type = other RNA
gggagactttcccattctgtagcagaatttggtgttgcctgtggtcttggtcccgcggagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9874 - RNA, 1052 nt, synthetic construct
  misc_feature 1..1052: note = mRNA product Design e-3 comprising derived and/or modified sequence from HRSV(A2)__P0DOE7.1__M (opt5)
  source 1..1052: mol_type = other RNA
gggagactttcccattctgtagcagaatttggtgttgcctgtggtcttggtcccgcggagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9875 - RNA, 1052 nt, synthetic construct
  misc_feature 1..1052: note = mRNA product Design e-3 comprising derived and/or modified sequence from HRSV(A2)__P0DOE7.1__M (opt6)
  source 1..1052: mol_type = other RNA
gggagactttcccattctgtagcagaatttggtgttgcctgtggtcttggtcccgcggagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9876 - RNA, 1052 nt, synthetic construct
  misc_feature 1..1052: note = mRNA product Design e-3 comprising derived and/or modified sequence from HRSV(A2)__P0DOE7.1__M (opt11)
  source 1..1052: mol_type = other RNA
gggagactttcccattctgtagcagaatttggtgttgcctgtggtcttggtcccgcggagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9877 - RNA, 1106 nt, synthetic construct
  misc_feature 1..1106: note = mRNA product Design e-4 comprising derived and/or modified sequence from HRSV(A2)__P0DOE7.1__M (wt)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9878 - RNA, 1106 nt, synthetic construct
  misc_feature 1..1106: note = mRNA product Design e-4 comprising derived and/or modified sequence from HRSV(A2)__P0DOE7.1__M (opt1)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9879 - RNA, 1106 nt, synthetic construct
  misc_feature 1..1106: note = mRNA product Design e-4 comprising derived and/or modified sequence from HRSV(A2)__P0DOE7.1__M (opt2)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9880 - RNA, 1106 nt, synthetic construct
  misc_feature 1..1106: note = mRNA product Design e-4 comprising derived and/or modified sequence from HRSV(A2)__P0DOE7.1__M (opt3)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9881 - RNA, 1106 nt, synthetic construct
  misc_feature 1..1106: note = mRNA product Design e-4 comprising derived and/or modified sequence from HRSV(A2)__P0DOE7.1__M (opt4)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9882 - RNA, 1106 nt, synthetic construct
  misc_feature 1..1106: note = mRNA product Design e-4 comprising derived and/or modified sequence from HRSV(A2)__P0DOE7.1__M (opt5)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9883 - RNA, 1106 nt, synthetic construct
  misc_feature 1..1106: note = mRNA product Design e-4 comprising derived and/or modified sequence from HRSV(A2)__P0DOE7.1__M (opt6)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9884 - RNA, 1106 nt, synthetic construct
  misc_feature 1..1106: note = mRNA product Design e-4 comprising derived and/or modified sequence from HRSV(A2)__P0DOE7.1__M (opt11)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9885 - RNA, 1073 nt, synthetic construct
  misc_feature 1..1073: note = mRNA product Design e-5 comprising derived and/or modified sequence from HRSV(A2)__P0DOE7.1__M (wt)
  source 1..1073: mol_type = other RNA
gggagagcggctcggccattttgtcccagtcagtccggaggctgcggctgcagaagtaccgcctgcggagtaactgcaaagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9886 - RNA, 1073 nt, synthetic construct
  misc_feature 1..1073: note = mRNA product Design e-5 comprising derived and/or modified sequence from HRSV(A2)__P0DOE7.1__M (opt1)
  source 1..1073: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9887 - RNA, 1073 nt, synthetic construct
  misc_feature 1..1073: note = mRNA product Design e-5 comprising derived and/or modified sequence from HRSV(A2)__P0DOE7.1__M (opt2)
  source 1..1073: mol_type = other RNA
gggagagcggctcggccattttgtcccagtcagtccggaggctgcggctgcagaagtaccgcctgcggagtaactgcaaagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9888 - RNA, 1073 nt, synthetic construct
  misc_feature 1..1073: note = mRNA product Design e-5 comprising derived and/or modified sequence from HRSV(A2)__P0DOE7.1__M (opt3)
  source 1..1073: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9889 - RNA, 1073 nt, synthetic construct
  misc_feature 1..1073: note = mRNA product Design e-5 comprising derived and/or modified sequence from HRSV(A2)__P0DOE7.1__M (opt4)
  source 1..1073: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9890 - RNA, 1073 nt, synthetic construct
  misc_feature 1..1073: note = mRNA product Design e-5 comprising derived and/or modified sequence from HRSV(A2)__P0DOE7.1__M (opt5)
  source 1..1073: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9891 - RNA, 1073 nt, synthetic construct
  misc_feature 1..1073: note = mRNA product Design e-5 comprising derived and/or modified sequence from HRSV(A2)__P0DOE7.1__M (opt6)
  source 1..1073: mol_type = other RNA
gggagagcggctcggccattttgtcccagtcagtccggaggctgcggctgcagaagtaccgcctgcggagtaactgcaaagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9892 - RNA, 1073 nt, synthetic construct
  misc_feature 1..1073: note = mRNA product Design e-5 comprising derived and/or modified sequence from HRSV(A2)__P0DOE7.1__M (opt11)
  source 1..1073: mol_type = other RNA
gggagagcggctcggccattttgtcccagtcagtccggaggctgcggctgcagaagtaccgcctgcggagtaactgcaaagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9893 - RNA, 1140 nt, synthetic construct
  misc_feature 1..1140: note = mRNA product Design e-6 comprising derived and/or modified sequence from HRSV(A2)__P0DOE7.1__M (wt)
  source 1..1140: mol_type = other RNA
gggagagcggctcggccattttgtcccagtcagtccggaggctgcggctgcagaagtaccgcctgcggagtaactgcaaagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9894 - RNA, 1140 nt, synthetic construct
  misc_feature 1..1140: note = mRNA product Design e-6 comprising derived and/or modified sequence from HRSV(A2)__P0DOE7.1__M (opt1)
  source 1..1140: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9895 - RNA, 1140 nt, synthetic construct
  misc_feature 1..1140: note = mRNA product Design e-6 comprising derived and/or modified sequence from HRSV(A2)__P0DOE7.1__M (opt2)
  source 1..1140: mol_type = other RNA
gggagagcggctcggccattttgtcccagtcagtccggaggctgcggctgcagaagtaccgcctgcggagtaactgcaaagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9896 - RNA, 1140 nt, synthetic construct
  misc_feature 1..1140: note = mRNA product Design e-6 comprising derived and/or modified sequence from HRSV(A2)__P0DOE7.1__M (opt3)
  source 1..1140: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9897 - RNA, 1140 nt, synthetic construct
  misc_feature 1..1140: note = mRNA product Design e-6 comprising derived and/or modified sequence from HRSV(A2)__P0DOE7.1__M (opt4)
  source 1..1140: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9898 - RNA, 1140 nt, synthetic construct
  misc_feature 1..1140: note = mRNA product Design e-6 comprising derived and/or modified sequence from HRSV(A2)__P0DOE7.1__M (opt5)
  source 1..1140: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9899 - RNA, 1140 nt, synthetic construct
  misc_feature 1..1140: note = mRNA product Design e-6 comprising derived and/or modified sequence from HRSV(A2)__P0DOE7.1__M (opt6)
  source 1..1140: mol_type = other RNA
gggagagcggctcggccattttgtcccagtcagtccggaggctgcggctgcagaagtaccgcctgcggagtaactgcaaagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9900 - RNA, 1140 nt, synthetic construct
  misc_feature 1..1140: note = mRNA product Design e-6 comprising derived and/or modified sequence from HRSV(A2)__P0DOE7.1__M (opt11)
  source 1..1140: mol_type = other RNA
gggagagcggctcggccattttgtcccagtcagtccggaggctgcggctgcagaagtaccgcctgcggagtaactgcaaagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9901 - RNA, 1356 nt, synthetic construct
  misc_feature 1..1356: note = mRNA product Design f-1 comprising derived and/or modified sequence from HRSV(A2)__P0DOE7.1__M (wt)
  source 1..1356: mol_type = other RNA
gggagagcggctcggccattttgtcccagtcagtccggaggctgcggctgcagaagtaccgcctgcggagtaactgcaaagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9902 - RNA, 1356 nt, synthetic construct
  misc_feature 1..1356: note = mRNA product Design f-1 comprising derived and/or modified sequence from HRSV(A2)__P0DOE7.1__M (opt1)
  source 1..1356: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9903 - RNA, 1356 nt, synthetic construct
  misc_feature 1..1356: note = mRNA product Design f-1 comprising derived and/or modified sequence from HRSV(A2)__P0DOE7.1__M (opt2)
  source 1..1356: mol_type = other RNA
gggagagcggctcggccattttgtcccagtcagtccggaggctgcggctgcagaagtaccgcctgcggagtaactgcaaagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9904 - RNA, 1356 nt, synthetic construct
  misc_feature 1..1356: note = mRNA product Design f-1 comprising derived and/or modified sequence from HRSV(A2)__P0DOE7.1__M (opt3)
  source 1..1356: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9905 - RNA, 1356 nt, synthetic construct
  misc_feature 1..1356: note = mRNA product Design f-1 comprising derived and/or modified sequence from HRSV(A2)__P0DOE7.1__M (opt4)
  source 1..1356: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9906 - RNA, 1356 nt, synthetic construct
  misc_feature 1..1356: note = mRNA product Design f-1 comprising derived and/or modified sequence from HRSV(A2)__P0DOE7.1__M (opt5)
  source 1..1356: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9907 - RNA, 1356 nt, synthetic construct
  misc_feature 1..1356: note = mRNA product Design f-1 comprising derived and/or modified sequence from HRSV(A2)__P0DOE7.1__M (opt6)
  source 1..1356: mol_type = other RNA
gggagagcggctcggccattttgtcccagtcagtccggaggctgcggctgcagaagtaccgcctgcggagtaactgcaaagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9908 - RNA, 1356 nt, synthetic construct
  misc_feature 1..1356: note = mRNA product Design f-1 comprising derived and/or modified sequence from HRSV(A2)__P0DOE7.1__M (opt11)
  source 1..1356: mol_type = other RNA
gggagagcggctcggccattttgtcccagtcagtccggaggctgcggctgcagaagtaccgcctgcggagtaactgcaaagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9909 - RNA, 1136 nt, synthetic construct
  misc_feature 1..1136: note = mRNA product Design f-2 comprising derived and/or modified sequence from HRSV(A2)__P0DOE7.1__M (wt)
  source 1..1136: mol_type = other RNA
gggagagcggctcggccattttgtcccagtcagtccggaggctgcggctgcagaagtaccgcctgcggagtaactgcaaagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9910 - RNA, 1136 nt, synthetic construct
  misc_feature 1..1136: note = mRNA product Design f-2 comprising derived and/or modified sequence from HRSV(A2)__P0DOE7.1__M (opt1)
  source 1..1136: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9911 - RNA, 1136 nt, synthetic construct
  misc_feature 1..1136: note = mRNA product Design f-2 comprising derived and/or modified sequence from HRSV(A2)__P0DOE7.1__M (opt2)
  source 1..1136: mol_type = other RNA
gggagagcggctcggccattttgtcccagtcagtccggaggctgcggctgcagaagtaccgcctgcggagtaactgcaaagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9912 - RNA, 1136 nt, synthetic construct
  misc_feature 1..1136: note = mRNA product Design f-2 comprising derived and/or modified sequence from HRSV(A2)__P0DOE7.1__M (opt3)
  source 1..1136: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9913 - RNA, 1136 nt, synthetic construct
  misc_feature 1..1136: note = mRNA product Design f-2 comprising derived and/or modified sequence from HRSV(A2)__P0DOE7.1__M (opt4)
  source 1..1136: mol_type = other RNA
gggagagcggctcggccattttgtcccagtcagtccggaggctgcggctgcagaagtaccgcctgcggagtaactgcaaagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9914 - RNA, 1136 nt, synthetic construct
  misc_feature 1..1136: note = mRNA product Design f-2 comprising derived and/or modified sequence from HRSV(A2)__P0DOE7.1__M (opt5)
  source 1..1136: mol_type = other RNA
gggagagcggctcggccattttgtcccagtcagtccggaggctgcggctgcagaagtaccgcctgcggagtaactgcaaagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9915 - RNA, 1136 nt, synthetic construct
  misc_feature 1..1136: note = mRNA product Design f-2 comprising derived and/or modified sequence from HRSV(A2)__P0DOE7.1__M (opt6)
  source 1..1136: mol_type = other RNA
gggagagcggctcggccattttgtcccagtcagtccggaggctgcggctgcagaagtaccgcctgcggagtaactgcaaagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9916 - RNA, 1136 nt, synthetic construct
  misc_feature 1..1136: note = mRNA product Design f-2 comprising derived and/or modified sequence from HRSV(A2)__P0DOE7.1__M (opt11)
  source 1..1136: mol_type = other RNA
gggagagcggctcggccattttgtcccagtcagtccggaggctgcggctgcagaagtaccgcctgcggagtaactgcaaagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9917 - RNA, 1127 nt, synthetic construct
  misc_feature 1..1127: note = mRNA product Design f-3 comprising derived and/or modified sequence from HRSV(A2)__P0DOE7.1__M (wt)
  source 1..1127: mol_type = other RNA
gggagagtcccgcagtcggcgtccagcggctctgcttgttcgtgtgtgtgtcgttgcaggccttattcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9918 - RNA, 1127 nt, synthetic construct
  misc_feature 1..1127: note = mRNA product Design f-3 comprising derived and/or modified sequence from HRSV(A2)__P0DOE7.1__M (opt1)
  source 1..1127: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9919 - RNA, 1127 nt, synthetic construct
  misc_feature 1..1127: note = mRNA product Design f-3 comprising derived and/or modified sequence from HRSV(A2)__P0DOE7.1__M (opt2)
  source 1..1127: mol_type = other RNA
gggagagtcccgcagtcggcgtccagcggctctgcttgttcgtgtgtgtgtcgttgcaggccttattcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9920 - RNA, 1127 nt, synthetic construct
  misc_feature 1..1127: note = mRNA product Design f-3 comprising derived and/or modified sequence from HRSV(A2)__P0DOE7.1__M (opt3)
  source 1..1127: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9921 - RNA, 1127 nt, synthetic construct
  misc_feature 1..1127: note = mRNA product Design f-3 comprising derived and/or modified sequence from HRSV(A2)__P0DOE7.1__M (opt4)
  source 1..1127: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9922 - RNA, 1127 nt, synthetic construct
  misc_feature 1..1127: note = mRNA product Design f-3 comprising derived and/or modified sequence from HRSV(A2)__P0DOE7.1__M (opt5)
  source 1..1127: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9923 - RNA, 1127 nt, synthetic construct
  misc_feature 1..1127: note = mRNA product Design f-3 comprising derived and/or modified sequence from HRSV(A2)__P0DOE7.1__M (opt6)
  source 1..1127: mol_type = other RNA
gggagagtcccgcagtcggcgtccagcggctctgcttgttcgtgtgtgtgtcgttgcaggccttattcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9924 - RNA, 1127 nt, synthetic construct
  misc_feature 1..1127: note = mRNA product Design f-3 comprising derived and/or modified sequence from HRSV(A2)__P0DOE7.1__M (opt11)
  source 1..1127: mol_type = other RNA
gggagagtcccgcagtcggcgtccagcggctctgcttgttcgtgtgtgtgtcgttgcaggccttattcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9925 - RNA, 1343 nt, synthetic construct
  misc_feature 1..1343: note = mRNA product Design f-4 comprising derived and/or modified sequence from HRSV(A2)__P0DOE7.1__M (wt)
  source 1..1343: mol_type = other RNA
gggagagtcccgcagtcggcgtccagcggctctgcttgttcgtgtgtgtgtcgttgcaggccttattcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9926 - RNA, 1343 nt, synthetic construct
  misc_feature 1..1343: note = mRNA product Design f-4 comprising derived and/or modified sequence from HRSV(A2)__P0DOE7.1__M (opt1)
  source 1..1343: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9927 - RNA, 1343 nt, synthetic construct
  misc_feature 1..1343: note = mRNA product Design f-4 comprising derived and/or modified sequence from HRSV(A2)__P0DOE7.1__M (opt2)
  source 1..1343: mol_type = other RNA
gggagagtcccgcagtcggcgtccagcggctctgcttgttcgtgtgtgtgtcgttgcaggccttattcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9928 - RNA, 1343 nt, synthetic construct
  misc_feature 1..1343: note = mRNA product Design f-4 comprising derived and/or modified sequence from HRSV(A2)__P0DOE7.1__M (opt3)
  source 1..1343: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9929 - RNA, 1343 nt, synthetic construct
  misc_feature 1..1343: note = mRNA product Design f-4 comprising derived and/or modified sequence from HRSV(A2)__P0DOE7.1__M (opt4)
  source 1..1343: mol_type = other RNA
gggagagtcccgcagtcggcgtccagcggctctgcttgttcgtgtgtgtgtcgttgcaggccttattcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9930 - RNA, 1343 nt, synthetic construct
  misc_feature 1..1343: note = mRNA product Design f-4 comprising derived and/or modified sequence from HRSV(A2)__P0DOE7.1__M (opt5)
  source 1..1343: mol_type = other RNA
gggagagtcccgcagtcggcgtccagcggctctgcttgttcgtgtgtgtgtcgttgcaggccttattcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9931 - RNA, 1343 nt, synthetic construct
  misc_feature 1..1343: note = mRNA product Design f-4 comprising derived and/or modified sequence from HRSV(A2)__P0DOE7.1__M (opt6)
  source 1..1343: mol_type = other RNA
gggagagtcccgcagtcggcgtccagcggctctgcttgttcgtgtgtgtgtcgttgcaggccttattcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9932 - RNA, 1343 nt, synthetic construct
  misc_feature 1..1343: note = mRNA product Design f-4 comprising derived and/or modified sequence from HRSV(A2)__P0DOE7.1__M (opt11)
  source 1..1343: mol_type = other RNA
gggagagtcccgcagtcggcgtccagcggctctgcttgttcgtgtgtgtgtcgttgcaggccttattcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9933 - RNA, 1119 nt, synthetic construct
  misc_feature 1..1119: note = mRNA product Design f-5 comprising derived and/or modified sequence from HRSV(A2)__P0DOE7.1__M (wt)
  source 1..1119: mol_type = other RNA
gggagactttcccattctgtagcagaatttggtgttgcctgtggtcttggtcccgcggagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9934 - RNA, 1119 nt, synthetic construct
  misc_feature 1..1119: note = mRNA product Design f-5 comprising derived and/or modified sequence from HRSV(A2)__P0DOE7.1__M (opt1)
  source 1..1119: mol_type = other RNA
gggagactttcccattctgtagcagaatttggtgttgcctgtggtcttggtcccgcggagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9935 - RNA, 1119 nt, synthetic construct
  misc_feature 1..1119: note = mRNA product Design f-5 comprising derived and/or modified sequence from HRSV(A2)__P0DOE7.1__M (opt2)
  source 1..1119: mol_type = other RNA
gggagactttcccattctgtagcagaatttggtgttgcctgtggtcttggtcccgcggagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9936 - RNA, 1119 nt, synthetic construct
  misc_feature 1..1119: note = mRNA product Design f-5 comprising derived and/or modified sequence from HRSV(A2)__P0DOE7.1__M (opt3)
  source 1..1119: mol_type = other RNA
gggagactttcccattctgtagcagaatttggtgttgcctgtggtcttggtcccgcggagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9937 - RNA, 1119 nt, synthetic construct
  misc_feature 1..1119: note = mRNA product Design f-5 comprising derived and/or modified sequence from HRSV(A2)__P0DOE7.1__M (opt4)
  source 1..1119: mol_type = other RNA
gggagactttcccattctgtagcagaatttggtgttgcctgtggtcttggtcccgcggagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9938 - RNA, 1119 nt, synthetic construct
  misc_feature 1..1119: note = mRNA product Design f-5 comprising derived and/or modified sequence from HRSV(A2)__P0DOE7.1__M (opt5)
  source 1..1119: mol_type = other RNA
gggagactttcccattctgtagcagaatttggtgttgcctgtggtcttggtcccgcggagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9939 - RNA, 1119 nt, synthetic construct
  misc_feature 1..1119: note = mRNA product Design f-5 comprising derived and/or modified sequence from HRSV(A2)__P0DOE7.1__M (opt6)
  source 1..1119: mol_type = other RNA
gggagactttcccattctgtagcagaatttggtgttgcctgtggtcttggtcccgcggagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9940 - RNA, 1119 nt, synthetic construct
  misc_feature 1..1119: note = mRNA product Design f-5 comprising derived and/or modified sequence from HRSV(A2)__P0DOE7.1__M (opt11)
  source 1..1119: mol_type = other RNA
gggagactttcccattctgtagcagaatttggtgttgcctgtggtcttggtcccgcggagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9941 - RNA, 1115 nt, synthetic construct
  misc_feature 1..1115: note = mRNA product Design g-1 comprising derived and/or modified sequence from HRSV(A2)__P0DOE7.1__M (wt)
  source 1..1115: mol_type = other RNA
gggagactttcccattctgtagcagaatttggtgttgcctgtggtcttggtcccgcggagaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9942 - RNA, 1115 nt, synthetic construct
  misc_feature 1..1115: note = mRNA product Design g-1 comprising derived and/or modified sequence from HRSV(A2)__P0DOE7.1__M (opt1)
  source 1..1115: mol_type = other RNA
gggagactttcccattctgtagcagaatttggtgttgcctgtggtcttggtcccgcggagaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9943 - RNA, 1115 nt, synthetic construct
  misc_feature 1..1115: note = mRNA product Design g-1 comprising derived and/or modified sequence from HRSV(A2)__P0DOE7.1__M (opt2)
  source 1..1115: mol_type = other RNA
gggagactttcccattctgtagcagaatttggtgttgcctgtggtcttggtcccgcggagaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9944 - RNA, 1115 nt, synthetic construct
  misc_feature 1..1115: note = mRNA product Design g-1 comprising derived and/or modified sequence from HRSV(A2)__P0DOE7.1__M (opt3)
  source 1..1115: mol_type = other RNA
gggagactttcccattctgtagcagaatttggtgttgcctgtggtcttggtcccgcggagaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9945 - RNA, 1115 nt, synthetic construct
  misc_feature 1..1115: note = mRNA product Design g-1 comprising derived and/or modified sequence from HRSV(A2)__P0DOE7.1__M (opt4)
  source 1..1115: mol_type = other RNA
gggagactttcccattctgtagcagaatttggtgttgcctgtggtcttggtcccgcggagaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9946 - RNA, 1115 nt, synthetic construct
  misc_feature 1..1115: note = mRNA product Design g-1 comprising derived and/or modified sequence from HRSV(A2)__P0DOE7.1__M (opt5)
  source 1..1115: mol_type = other RNA
gggagactttcccattctgtagcagaatttggtgttgcctgtggtcttggtcccgcggagaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9947 - RNA, 1115 nt, synthetic construct
  misc_feature 1..1115: note = mRNA product Design g-1 comprising derived and/or modified sequence from HRSV(A2)__P0DOE7.1__M (opt6)
  source 1..1115: mol_type = other RNA
gggagactttcccattctgtagcagaatttggtgttgcctgtggtcttggtcccgcggagaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9948 - RNA, 1115 nt, synthetic construct
  misc_feature 1..1115: note = mRNA product Design g-1 comprising derived and/or modified sequence from HRSV(A2)__P0DOE7.1__M (opt11)
  source 1..1115: mol_type = other RNA
gggagactttcccattctgtagcagaatttggtgttgcctgtggtcttggtcccgcggagaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9949 - RNA, 1130 nt, synthetic construct
  misc_feature 1..1130: note = mRNA product Design g-2 comprising derived and/or modified sequence from HRSV(A2)__P0DOE7.1__M (wt)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9950 - RNA, 1130 nt, synthetic construct
  misc_feature 1..1130: note = mRNA product Design g-2 comprising derived and/or modified sequence from HRSV(A2)__P0DOE7.1__M (opt1)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9951 - RNA, 1130 nt, synthetic construct
  misc_feature 1..1130: note = mRNA product Design g-2 comprising derived and/or modified sequence from HRSV(A2)__P0DOE7.1__M (opt2)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9952 - RNA, 1130 nt, synthetic construct
  misc_feature 1..1130: note = mRNA product Design g-2 comprising derived and/or modified sequence from HRSV(A2)__P0DOE7.1__M (opt3)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9953 - RNA, 1130 nt, synthetic construct
  misc_feature 1..1130: note = mRNA product Design g-2 comprising derived and/or modified sequence from HRSV(A2)__P0DOE7.1__M (opt4)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9954 - RNA, 1130 nt, synthetic construct
  misc_feature 1..1130: note = mRNA product Design g-2 comprising derived and/or modified sequence from HRSV(A2)__P0DOE7.1__M (opt5)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9955 - RNA, 1130 nt, synthetic construct
  misc_feature 1..1130: note = mRNA product Design g-2 comprising derived and/or modified sequence from HRSV(A2)__P0DOE7.1__M (opt6)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9956 - RNA, 1130 nt, synthetic construct
  misc_feature 1..1130: note = mRNA product Design g-2 comprising derived and/or modified sequence from HRSV(A2)__P0DOE7.1__M (opt11)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9957 - RNA, 1362 nt, synthetic construct
  misc_feature 1..1362: note = mRNA product Design g-3 comprising derived and/or modified sequence from HRSV(A2)__P0DOE7.1__M (wt)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9958 - RNA, 1362 nt, synthetic construct
  misc_feature 1..1362: note = mRNA product Design g-3 comprising derived and/or modified sequence from HRSV(A2)__P0DOE7.1__M (opt1)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9959 - RNA, 1362 nt, synthetic construct
  misc_feature 1..1362: note = mRNA product Design g-3 comprising derived and/or modified sequence from HRSV(A2)__P0DOE7.1__M (opt2)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9960 - RNA, 1362 nt, synthetic construct
  misc_feature 1..1362: note = mRNA product Design g-3 comprising derived and/or modified sequence from HRSV(A2)__P0DOE7.1__M (opt3)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9961 - RNA, 1362 nt, synthetic construct
  misc_feature 1..1362: note = mRNA product Design g-3 comprising derived and/or modified sequence from HRSV(A2)__P0DOE7.1__M (opt4)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9962 - RNA, 1362 nt, synthetic construct
  misc_feature 1..1362: note = mRNA product Design g-3 comprising derived and/or modified sequence from HRSV(A2)__P0DOE7.1__M (opt5)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9963 - RNA, 1362 nt, synthetic construct
  misc_feature 1..1362: note = mRNA product Design g-3 comprising derived and/or modified sequence from HRSV(A2)__P0DOE7.1__M (opt6)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9964 - RNA, 1362 nt, synthetic construct
  misc_feature 1..1362: note = mRNA product Design g-3 comprising derived and/or modified sequence from HRSV(A2)__P0DOE7.1__M (opt11)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9965 - RNA, 1157 nt, synthetic construct
  misc_feature 1..1157: note = mRNA product Design g-4 comprising derived and/or modified sequence from HRSV(A2)__P0DOE7.1__M (wt)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9966 - RNA, 1157 nt, synthetic construct
  misc_feature 1..1157: note = mRNA product Design g-4 comprising derived and/or modified sequence from HRSV(A2)__P0DOE7.1__M (opt1)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9967 - RNA, 1157 nt, synthetic construct
  misc_feature 1..1157: note = mRNA product Design g-4 comprising derived and/or modified sequence from HRSV(A2)__P0DOE7.1__M (opt2)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9968 - RNA, 1157 nt, synthetic construct
  misc_feature 1..1157: note = mRNA product Design g-4 comprising derived and/or modified sequence from HRSV(A2)__P0DOE7.1__M (opt3)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9969 - RNA, 1157 nt, synthetic construct
  misc_feature 1..1157: note = mRNA product Design g-4 comprising derived and/or modified sequence from HRSV(A2)__P0DOE7.1__M (opt4)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9970 - RNA, 1157 nt, synthetic construct
  misc_feature 1..1157: note = mRNA product Design g-4 comprising derived and/or modified sequence from HRSV(A2)__P0DOE7.1__M (opt5)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9971 - RNA, 1157 nt, synthetic construct
  misc_feature 1..1157: note = mRNA product Design g-4 comprising derived and/or modified sequence from HRSV(A2)__P0DOE7.1__M (opt6)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9972 - RNA, 1157 nt, synthetic construct
  misc_feature 1..1157: note = mRNA product Design g-4 comprising derived and/or modified sequence from HRSV(A2)__P0DOE7.1__M (opt11)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9973 - RNA, 1133 nt, synthetic construct
  misc_feature 1..1133: note = mRNA product Design g-5 comprising derived and/or modified sequence from HRSV(A2)__P0DOE7.1__M (wt)
  source 1..1133: mol_type = other RNA
gggagacccgtgacccggaagttgtacggctacgcgactttccctcccacaaaccctcgcgcccttcctttcctacttgggcccggcagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9974 - RNA, 1133 nt, synthetic construct
  misc_feature 1..1133: note = mRNA product Design g-5 comprising derived and/or modified sequence from HRSV(A2)__P0DOE7.1__M (opt1)
  source 1..1133: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9975 - RNA, 1133 nt, synthetic construct
  misc_feature 1..1133: note = mRNA product Design g-5 comprising derived and/or modified sequence from HRSV(A2)__P0DOE7.1__M (opt2)
  source 1..1133: mol_type = other RNA
gggagacccgtgacccggaagttgtacggctacgcgactttccctcccacaaaccctcgcgcccttcctttcctacttgggcccggcagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9976 - RNA, 1133 nt, synthetic construct
  misc_feature 1..1133: note = mRNA product Design g-5 comprising derived and/or modified sequence from HRSV(A2)__P0DOE7.1__M (opt3)
  source 1..1133: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9977 - RNA, 1133 nt, synthetic construct
  misc_feature 1..1133: note = mRNA product Design g-5 comprising derived and/or modified sequence from HRSV(A2)__P0DOE7.1__M (opt4)
  source 1..1133: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9978 - RNA, 1133 nt, synthetic construct
  misc_feature 1..1133: note = mRNA product Design g-5 comprising derived and/or modified sequence from HRSV(A2)__P0DOE7.1__M (opt5)
  source 1..1133: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9979 - RNA, 1133 nt, synthetic construct
  misc_feature 1..1133: note = mRNA product Design g-5 comprising derived and/or modified sequence from HRSV(A2)__P0DOE7.1__M (opt6)
  source 1..1133: mol_type = other RNA
gggagacccgtgacccggaagttgtacggctacgcgactttccctcccacaaaccctcgcgcccttcctttcctacttgggcccggcagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9980 - RNA, 1133 nt, synthetic construct
  misc_feature 1..1133: note = mRNA product Design g-5 comprising derived and/or modified sequence from HRSV(A2)__P0DOE7.1__M (opt11)
  source 1..1133: mol_type = other RNA
gggagacccgtgacccggaagttgtacggctacgcgactttccctcccacaaaccctcgcgcccttcctttcctacttgggcccggcagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9981 - RNA, 1149 nt, synthetic construct
  misc_feature 1..1149: note = mRNA product Design h-1 comprising derived and/or modified sequence from HRSV(A2)__P0DOE7.1__M (wt)
  source 1..1149: mol_type = other RNA
gggagacccgtgacccggaagttgtacggctacgcgactttccctcccacaaaccctcgcgcccttcctttcctacttgggcccggcagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9982 - RNA, 1149 nt, synthetic construct
  misc_feature 1..1149: note = mRNA product Design h-1 comprising derived and/or modified sequence from HRSV(A2)__P0DOE7.1__M (opt1)
  source 1..1149: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9983 - RNA, 1149 nt, synthetic construct
  misc_feature 1..1149: note = mRNA product Design h-1 comprising derived and/or modified sequence from HRSV(A2)__P0DOE7.1__M (opt2)
  source 1..1149: mol_type = other RNA
gggagacccgtgacccggaagttgtacggctacgcgactttccctcccacaaaccctcgcgcccttcctttcctacttgggcccggcagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9984 - RNA, 1149 nt, synthetic construct
  misc_feature 1..1149: note = mRNA product Design h-1 comprising derived and/or modified sequence from HRSV(A2)__P0DOE7.1__M (opt3)
  source 1..1149: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9985 - RNA, 1149 nt, synthetic construct
  misc_feature 1..1149: note = mRNA product Design h-1 comprising derived and/or modified sequence from HRSV(A2)__P0DOE7.1__M (opt4)
  source 1..1149: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9986 - RNA, 1149 nt, synthetic construct
  misc_feature 1..1149: note = mRNA product Design h-1 comprising derived and/or modified sequence from HRSV(A2)__P0DOE7.1__M (opt5)
  source 1..1149: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9987 - RNA, 1149 nt, synthetic construct
  misc_feature 1..1149: note = mRNA product Design h-1 comprising derived and/or modified sequence from HRSV(A2)__P0DOE7.1__M (opt6)
  source 1..1149: mol_type = other RNA
gggagacccgtgacccggaagttgtacggctacgcgactttccctcccacaaaccctcgcgcccttcctttcctacttgggcccggcagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9988 - RNA, 1149 nt, synthetic construct
  misc_feature 1..1149: note = mRNA product Design h-1 comprising derived and/or modified sequence from HRSV(A2)__P0DOE7.1__M (opt11)
  source 1..1149: mol_type = other RNA
gggagacccgtgacccggaagttgtacggctacgcgactttccctcccacaaaccctcgcgcccttcctttcctacttgggcccggcagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9989 - RNA, 1365 nt, synthetic construct
  misc_feature 1..1365: note = mRNA product Design h-2 comprising derived and/or modified sequence from HRSV(A2)__P0DOE7.1__M (wt)
  source 1..1365: mol_type = other RNA
gggagacccgtgacccggaagttgtacggctacgcgactttccctcccacaaaccctcgcgcccttcctttcctacttgggcccggcagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9990 - RNA, 1365 nt, synthetic construct
  misc_feature 1..1365: note = mRNA product Design h-2 comprising derived and/or modified sequence from HRSV(A2)__P0DOE7.1__M (opt1)
  source 1..1365: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9991 - RNA, 1365 nt, synthetic construct
  misc_feature 1..1365: note = mRNA product Design h-2 comprising derived and/or modified sequence from HRSV(A2)__P0DOE7.1__M (opt2)
  source 1..1365: mol_type = other RNA
gggagacccgtgacccggaagttgtacggctacgcgactttccctcccacaaaccctcgcgcccttcctttcctacttgggcccggcagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9992 - RNA, 1365 nt, synthetic construct
  misc_feature 1..1365: note = mRNA product Design h-2 comprising derived and/or modified sequence from HRSV(A2)__P0DOE7.1__M (opt3)
  source 1..1365: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9993 - RNA, 1365 nt, synthetic construct
  misc_feature 1..1365: note = mRNA product Design h-2 comprising derived and/or modified sequence from HRSV(A2)__P0DOE7.1__M (opt4)
  source 1..1365: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9994 - RNA, 1365 nt, synthetic construct
  misc_feature 1..1365: note = mRNA product Design h-2 comprising derived and/or modified sequence from HRSV(A2)__P0DOE7.1__M (opt5)
  source 1..1365: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9995 - RNA, 1365 nt, synthetic construct
  misc_feature 1..1365: note = mRNA product Design h-2 comprising derived and/or modified sequence from HRSV(A2)__P0DOE7.1__M (opt6)
  source 1..1365: mol_type = other RNA
gggagacccgtgacccggaagttgtacggctacgcgactttccctcccacaaaccctcgcgcccttcctttcctacttgggcccggcagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9996 - RNA, 1365 nt, synthetic construct
  misc_feature 1..1365: note = mRNA product Design h-2 comprising derived and/or modified sequence from HRSV(A2)__P0DOE7.1__M (opt11)
  source 1..1365: mol_type = other RNA
gggagacccgtgacccggaagttgtacggctacgcgactttccctcccacaaaccctcgcgcccttcctttcctacttgggcccggcagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9997 - RNA, 1145 nt, synthetic construct
  misc_feature 1..1145: note = mRNA product Design h-3 comprising derived and/or modified sequence from HRSV(A2)__P0DOE7.1__M (wt)
  source 1..1145: mol_type = other RNA
gggagacccgtgacccggaagttgtacggctacgcgactttccctcccacaaaccctcgcgcccttcctttcctacttgggcccggcagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9998 - RNA, 1145 nt, synthetic construct
  misc_feature 1..1145: note = mRNA product Design h-3 comprising derived and/or modified sequence from HRSV(A2)__P0DOE7.1__M (opt1)
  source 1..1145: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9999 - RNA, 1145 nt, synthetic construct
  misc_feature 1..1145: note = mRNA product Design h-3 comprising derived and/or modified sequence from HRSV(A2)__P0DOE7.1__M (opt2)
  source 1..1145: mol_type = other RNA
gggagacccgtgacccggaagttgtacggctacgcgactttccctcccacaaaccctcgcgcccttcctttcctacttgggcccggcagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10000 - RNA, 1145 nt, synthetic construct
  misc_feature 1..1145: note = mRNA product Design h-3 comprising derived and/or modified sequence from HRSV(A2)__P0DOE7.1__M (opt3)
  source 1..1145: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10001 - RNA, 1145 nt, synthetic construct
  misc_feature 1..1145: note = mRNA product Design h-3 comprising derived and/or modified sequence from HRSV(A2)__P0DOE7.1__M (opt4)
  source 1..1145: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10002 - RNA, 1145 nt, synthetic construct
  misc_feature 1..1145: note = mRNA product Design h-3 comprising derived and/or modified sequence from HRSV(A2)__P0DOE7.1__M (opt5)
  source 1..1145: mol_type = other RNA
gggagacccgtgacccggaagttgtacggctacgcgactttccctcccacaaaccctcgcgcccttcctttcctacttgggcccggcagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10003 - RNA, 1145 nt, synthetic construct
  misc_feature 1..1145: note = mRNA product Design h-3 comprising derived and/or modified sequence from HRSV(A2)__P0DOE7.1__M (opt6)
  source 1..1145: mol_type = other RNA
gggagacccgtgacccggaagttgtacggctacgcgactttccctcccacaaaccctcgcgcccttcctttcctacttgggcccggcagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10004 - RNA, 1145 nt, synthetic construct
  misc_feature 1..1145: note = mRNA product Design h-3 comprising derived and/or modified sequence from HRSV(A2)__P0DOE7.1__M (opt11)
  source 1..1145: mol_type = other RNA
gggagacccgtgacccggaagttgtacggctacgcgactttccctcccacaaaccctcgcgcccttcctttcctacttgggcccggcagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10005 - RNA, 1208 nt, synthetic construct
  misc_feature 1..1208: note = mRNA product Design h-4 comprising derived and/or modified sequence from HRSV(A2)__P0DOE7.1__M (wt)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10006 - RNA, 1208 nt, synthetic construct
  misc_feature 1..1208: note = mRNA product Design h-4 comprising derived and/or modified sequence from HRSV(A2)__P0DOE7.1__M (opt1)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10007 - RNA, 1208 nt, synthetic construct
  misc_feature 1..1208: note = mRNA product Design h-4 comprising derived and/or modified sequence from HRSV(A2)__P0DOE7.1__M (opt2)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10008 - RNA, 1208 nt, synthetic construct
  misc_feature 1..1208: note = mRNA product Design h-4 comprising derived and/or modified sequence from HRSV(A2)__P0DOE7.1__M (opt3)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10009 - RNA, 1208 nt, synthetic construct
  misc_feature 1..1208: note = mRNA product Design h-4 comprising derived and/or modified sequence from HRSV(A2)__P0DOE7.1__M (opt4)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10010 - RNA, 1208 nt, synthetic construct
  misc_feature 1..1208: note = mRNA product Design h-4 comprising derived and/or modified sequence from HRSV(A2)__P0DOE7.1__M (opt5)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10011 - RNA, 1208 nt, synthetic construct
  misc_feature 1..1208: note = mRNA product Design h-4 comprising derived and/or modified sequence from HRSV(A2)__P0DOE7.1__M (opt6)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10012 - RNA, 1208 nt, synthetic construct
  misc_feature 1..1208: note = mRNA product Design h-4 comprising derived and/or modified sequence from HRSV(A2)__P0DOE7.1__M (opt11)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10013 - RNA, 1224 nt, synthetic construct
  misc_feature 1..1224: note = mRNA product Design h-5 comprising derived and/or modified sequence from HRSV(A2)__P0DOE7.1__M (wt)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10014 - RNA, 1224 nt, synthetic construct
  misc_feature 1..1224: note = mRNA product Design h-5 comprising derived and/or modified sequence from HRSV(A2)__P0DOE7.1__M (opt1)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10015 - RNA, 1224 nt, synthetic construct
  misc_feature 1..1224: note = mRNA product Design h-5 comprising derived and/or modified sequence from HRSV(A2)__P0DOE7.1__M (opt2)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10016 - RNA, 1224 nt, synthetic construct
  misc_feature 1..1224: note = mRNA product Design h-5 comprising derived and/or modified sequence from HRSV(A2)__P0DOE7.1__M (opt3)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10017 - RNA, 1224 nt, synthetic construct
  misc_feature 1..1224: note = mRNA product Design h-5 comprising derived and/or modified sequence from HRSV(A2)__P0DOE7.1__M (opt4)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10018 - RNA, 1224 nt, synthetic construct
  misc_feature 1..1224: note = mRNA product Design h-5 comprising derived and/or modified sequence from HRSV(A2)__P0DOE7.1__M (opt5)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10019 - RNA, 1224 nt, synthetic construct
  misc_feature 1..1224: note = mRNA product Design h-5 comprising derived and/or modified sequence from HRSV(A2)__P0DOE7.1__M (opt6)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10020 - RNA, 1224 nt, synthetic construct
  misc_feature 1..1224: note = mRNA product Design h-5 comprising derived and/or modified sequence from HRSV(A2)__P0DOE7.1__M (opt11)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10021 - RNA, 1157 nt, synthetic construct
  misc_feature 1..1157: note = mRNA product Design i-1 comprising derived and/or modified sequence from HRSV(A2)__P0DOE7.1__M (wt)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10022 - RNA, 1157 nt, synthetic construct
  misc_feature 1..1157: note = mRNA product Design i-1 comprising derived and/or modified sequence from HRSV(A2)__P0DOE7.1__M (opt1)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10023 - RNA, 1157 nt, synthetic construct
  misc_feature 1..1157: note = mRNA product Design i-1 comprising derived and/or modified sequence from HRSV(A2)__P0DOE7.1__M (opt2)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10024 - RNA, 1157 nt, synthetic construct
  misc_feature 1..1157: note = mRNA product Design i-1 comprising derived and/or modified sequence from HRSV(A2)__P0DOE7.1__M (opt3)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10025 - RNA, 1157 nt, synthetic construct
  misc_feature 1..1157: note = mRNA product Design i-1 comprising derived and/or modified sequence from HRSV(A2)__P0DOE7.1__M (opt4)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10026 - RNA, 1157 nt, synthetic construct
  misc_feature 1..1157: note = mRNA product Design i-1 comprising derived and/or modified sequence from HRSV(A2)__P0DOE7.1__M (opt5)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10027 - RNA, 1157 nt, synthetic construct
  misc_feature 1..1157: note = mRNA product Design i-1 comprising derived and/or modified sequence from HRSV(A2)__P0DOE7.1__M (opt6)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10028 - RNA, 1157 nt, synthetic construct
  misc_feature 1..1157: note = mRNA product Design i-1 comprising derived and/or modified sequence from HRSV(A2)__P0DOE7.1__M (opt11)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10029 - RNA, 1157 nt, synthetic construct
  misc_feature 1..1157: note = mRNA product Design i-2 comprising derived and/or modified sequence from HRSV(A2)__P0DOE7.1__M (wt)
  source 1..1157: mol_type = other RNA
gggagaggcgctgcctacggaggtggcagccatctccttctcggcatcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10030 - RNA, 1157 nt, synthetic construct
  misc_feature 1..1157: note = mRNA product Design i-2 comprising derived and/or modified sequence from HRSV(A2)__P0DOE7.1__M (opt1)
  source 1..1157: mol_type = other RNA
gggagaggcgctgcctacggaggtggcagccatctccttctcggcatcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10031 - RNA, 1157 nt, synthetic construct
  misc_feature 1..1157: note = mRNA product Design i-2 comprising derived and/or modified sequence from HRSV(A2)__P0DOE7.1__M (opt2)
  source 1..1157: mol_type = other RNA
gggagaggcgctgcctacggaggtggcagccatctccttctcggcatcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10032 - RNA, 1157 nt, synthetic construct
  misc_feature 1..1157: note = mRNA product Design i-2 comprising derived and/or modified sequence from HRSV(A2)__P0DOE7.1__M (opt3)
  source 1..1157: mol_type = other RNA
gggagaggcgctgcctacggaggtggcagccatctccttctcggcatcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10033 - RNA, 1157 nt, synthetic construct
  misc_feature 1..1157: note = mRNA product Design i-2 comprising derived and/or modified sequence from HRSV(A2)__P0DOE7.1__M (opt4)
  source 1..1157: mol_type = other RNA
gggagaggcgctgcctacggaggtggcagccatctccttctcggcatcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10034 - RNA, 1157 nt, synthetic construct
  misc_feature 1..1157: note = mRNA product Design i-2 comprising derived and/or modified sequence from HRSV(A2)__P0DOE7.1__M (opt5)
  source 1..1157: mol_type = other RNA
gggagaggcgctgcctacggaggtggcagccatctccttctcggcatcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10035 - RNA, 1157 nt, synthetic construct
  misc_feature 1..1157: note = mRNA product Design i-2 comprising derived and/or modified sequence from HRSV(A2)__P0DOE7.1__M (opt6)
  source 1..1157: mol_type = other RNA
gggagaggcgctgcctacggaggtggcagccatctccttctcggcatcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10036 - RNA, 1157 nt, synthetic construct
  misc_feature 1..1157: note = mRNA product Design i-2 comprising derived and/or modified sequence from HRSV(A2)__P0DOE7.1__M (opt11)
  source 1..1157: mol_type = other RNA
gggagaggcgctgcctacggaggtggcagccatctccttctcggcatcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10037 - RNA, 1153 nt, synthetic construct
  misc_feature 1..1153: note = mRNA product Design i-2 comprising derived and/or modified sequence from HRSV(A2)__P0DOE7.1__M (wt)
  source 1..1153: mol_type = other RNA
ggggcgctgcctacggaggtggcagccatctccttctcggcatcaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10038 - RNA, 1153 nt, synthetic construct
  misc_feature 1..1153: note = mRNA product Design i-2 comprising derived and/or modified sequence from HRSV(A2)__P0DOE7.1__M (opt1)
  source 1..1153: mol_type = other RNA
ggggcgctgcctacggaggtggcagccatctccttctcggcatcaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10039 - RNA, 1153 nt, synthetic construct
  misc_feature 1..1153: note = mRNA product Design i-2 comprising derived and/or modified sequence from HRSV(A2)__P0DOE7.1__M (opt2)
  source 1..1153: mol_type = other RNA
ggggcgctgcctacggaggtggcagccatctccttctcggcatcaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10040 - RNA, 1153 nt, synthetic construct
  misc_feature 1..1153: note = mRNA product Design i-2 comprising derived and/or modified sequence from HRSV(A2)__P0DOE7.1__M (opt3)
  source 1..1153: mol_type = other RNA
ggggcgctgcctacggaggtggcagccatctccttctcggcatcaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10041 - RNA, 1153 nt, synthetic construct
  misc_feature 1..1153: note = mRNA product Design i-2 comprising derived and/or modified sequence from HRSV(A2)__P0DOE7.1__M (opt4)
  source 1..1153: mol_type = other RNA
ggggcgctgcctacggaggtggcagccatctccttctcggcatcaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10042 - RNA, 1153 nt, synthetic construct
  misc_feature 1..1153: note = mRNA product Design i-2 comprising derived and/or modified sequence from HRSV(A2)__P0DOE7.1__M (opt5)
  source 1..1153: mol_type = other RNA
ggggcgctgcctacggaggtggcagccatctccttctcggcatcaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10043 - RNA, 1153 nt, synthetic construct
  misc_feature 1..1153: note = mRNA product Design i-2 comprising derived and/or modified sequence from HRSV(A2)__P0DOE7.1__M (opt6)
  source 1..1153: mol_type = other RNA
ggggcgctgcctacggaggtggcagccatctccttctcggcatcaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10044 - RNA, 1153 nt, synthetic construct
  misc_feature 1..1153: note = mRNA product Design i-2 comprising derived and/or modified sequence from HRSV(A2)__P0DOE7.1__M (opt11)
  source 1..1153: mol_type = other RNA
ggggcgctgcctacggaggtggcagccatctccttctcggcatcaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10045 - RNA, 988 nt, synthetic construct
  misc_feature 1..988: note = mRNA product Design i-3 comprising derived and/or modified sequence from HRSV(A2)__P0DOE7.1__M (wt)
  source 1..988: mol_type = other RNA
gggagaaagcttaccatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10046 - RNA, 988 nt, synthetic construct
  misc_feature 1..988: note = mRNA product Design i-3 comprising derived and/or modified sequence from HRSV(A2)__P0DOE7.1__M (opt1) R7595
  source 1..988: mol_type = other RNA
gggagaaagcttaccatggagacctacgtgaacaagctgcacgagggcagcacctacacggccgccgtccagtacaacgtgctcgagaaggacgacgaccccgcgtccctgaccatctgggtgccgatgttccagagctccatgcccgccgacctgctcatcaaggagctggccaacgtcaacatcctggtgaagcagatcagcacccccaaggggccctccctccgcgtgatgatcaacagccggtccgccgtcctggcccagatgccgagcaagttcaccatctgcgcgaacgtgtccctggacgagcgcagcaagctcgcctacgacgtgacgaccccctgcgagatcaaggcctgctccctgacctgcctcaagagcaagaacatgctgaccacggtcaaggacctgaccatgaagaccctgaaccccacccacgacatcatcgccctctgcgagttcgagaacatcgtgacgtccaagaaggtgatcatccccacctacctgcggagcatctccgtccgcaacaaggacctgaacaccctcgagaacatcaccacgaccgagttcaagaacgcgatcaccaacgccaagatcatcccgtacagcggcctgctgctcgtgatcaccgtgacggacaacaagggggccttcaagtacatcaagccccagtcccagttcatcgtcgacctgggcgcctacctggagaaggagagcatctactacgtgaccaccaactggaagcacaccgccacgcggttcgcgatcaagcccatggaggactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10047 - RNA, 988 nt, synthetic construct
  misc_feature 1..988: note = mRNA product Design i-3 comprising derived and/or modified sequence from HRSV(A2)__P0DOE7.1__M (opt2)
  source 1..988: mol_type = other RNA
gggagaaagcttaccatggagacctacgtcaacaagctccacgagggctccacctacaccgccgccgtccagtacaacgtcctcgagaaggacgacgaccccgcctccctcaccatctgggtccccatgttccagtcctccatgcccgccgacctcctcatcaaggagctcgccaacgtcaacatcctcgtcaagcagatctccacccccaagggcccctccctccgcgtcatgatcaactcccgctccgccgtcctcgcccagatgccctccaagttcaccatctgcgccaacgtctccctcgacgagcgctccaagctcgcctacgacgtcaccaccccctgcgagatcaaggcctgctccctcacctgcctcaagtccaagaacatgctcaccaccgtcaaggacctcaccatgaagaccctcaaccccacccacgacatcatcgccctctgcgagttcgagaacatcgtcacctccaagaaggtcatcatccccacctacctccgctccatctccgtccgcaacaaggacctcaacaccctcgagaacatcaccaccaccgagttcaagaacgccatcaccaacgccaagatcatcccctactccggcctcctcctcgtcatcaccgtcaccgacaacaagggcgccttcaagtacatcaagccccagtcccagttcatcgtcgacctcggcgcctacctcgagaaggagtccatctactacgtcaccaccaactggaagcacaccgccacccgcttcgccatcaagcccatggaggactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10048 - RNA, 988 nt, synthetic construct
  misc_feature 1..988: note = mRNA product Design i-3 comprising derived and/or modified sequence from HRSV(A2)__P0DOE7.1__M (opt3)
  source 1..988: mol_type = other RNA
gggagaaagcttaccatggagacctacgtgaacaagctgcacgaaggcagcacatatactgccgctgtccagtacaatgttctcgagaaagacgatgaccccgcatcccttacgatctgggtgcctatgttccaatcttcaatgccagccgatctgttgattaaggaattagcgaacgtaaatatactggtgaaacagatcagtaccccgaaggggcccagcctaagagtcatgattaactccaggtctgctgtgctcgcccagatgccttcgaaatttacaatctgcgcaaatgtttcactggacgagcggagcaaacttgcctatgatgtgactaccccatgtgaaattaaggcttgcagtctgacatgtttgaagtccaagaacatgctcaccactgtcaaagacctgacaatgaagaccctgaatcccacgcatgatatcatagcactctgcgagttcgagaacatcgtgacttctaaaaaggtaattatccctacctacttacgcagcatttccgttcgaaataaggacctgaacacacttgaaaatatcactaccacagagtttaaaaacgccataaccaatgctaagattatcccatattcaggattgctgctagtgattacggtcactgataacaaaggtgccttcaagtacatcaaaccccagagtcaatttatcgtggacctcggcgcgtatctggaaaaggagagcatttactacgtgacaaccaattggaaacacactgcaacacgtttcgccataaagcctatggaggattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10049 - RNA, 988 nt, synthetic construct
  misc_feature 1..988: note = mRNA product Design i-3 comprising derived and/or modified sequence from HRSV(A2)__P0DOE7.1__M (opt4)
  source 1..988: mol_type = other RNA
gggagaaagcttaccatggagacctacgtgaacaagctgcacgagggcagcacctacaccgccgccgtgcagtacaacgtgctggagaaggacgacgaccccgccagcctgaccatctgggtgcccatgttccagagcagcatgcccgccgacctgctgatcaaggagctggccaacgtgaacatcctggtgaagcagatcagcacccccaagggccccagcctgagagtgatgatcaacagcagaagcgccgtgctggcccagatgcccagcaagttcaccatctgcgccaacgtgagcctggacgagagaagcaagctggcctacgacgtgaccaccccctgcgagatcaaggcctgcagcctgacctgcctgaagagcaagaacatgctgaccaccgtgaaggacctgaccatgaagaccctgaaccccacccacgacatcatcgccctgtgcgagttcgagaacatcgtgaccagcaagaaggtgatcatccccacctacctgagaagcatcagcgtgagaaacaaggacctgaacaccctggagaacatcaccaccaccgagttcaagaacgccatcaccaacgccaagatcatcccctacagcggcctgctgctggtgatcaccgtgaccgacaacaagggcgccttcaagtacatcaagccccagagccagttcatcgtggacctgggcgcctacctggagaaggagagcatctactacgtgaccaccaactggaagcacaccgccaccagattcgccatcaagcccatggaggactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10050 - RNA, 988 nt, synthetic construct
  misc_feature 1..988: note = mRNA product Design i-3 comprising derived and/or modified sequence from HRSV(A2)__P0DOE7.1__M (opt5)
  source 1..988: mol_type = other RNA
gggagaaagcttaccatggagacctacgtgaacaagctgcacgaaggcagcacatatacggccgctgtccagtacaatgttctcgagaaagacgatgaccccgcctccctgaccatctgggtgcctatgttccaatctagcatgccggcggatcttctgattaaggaactcgctaacgtgaatatcctggtcaaacagatttccacacccaaggggccttctcttagagtgatgatcaacagccggtccgccgttctggcccagatgccctctaaatttaccatttgcgctaatgtgagcctcgacgagcgctccaagctggcctatgatgtcacaaccccttgtgaaatcaaggcttgcagcctgacatgtctcaaatctaagaacatgctgaccacggtgaaagaccttaccatgaagacactgaatcccacccatgatatcattgccctctgcgagttcgagaacatcgttacatccaaaaaggtgattatccctacctacctgagaagcatttctgtccggaataaggaccttaacacgctggaaaatatcacaaccacagagtttaaaaacgcgattaccaatgccaagatcatcccgtattccggactcctgctggtgattaccgtgacagataacaaaggcgctttcaagtacatcaaaccccagagccaatttattgtcgacctcggggcctatctggaaaaggagtctatctactacgttacgaccaattggaaacacacagctacccgcttcgccattaagcctatggaggattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10051 - RNA, 988 nt, synthetic construct
  misc_feature 1..988: note = mRNA product Design i-3 comprising derived and/or modified sequence from HRSV(A2)__P0DOE7.1__M (opt6)
  source 1..988: mol_type = other RNA
gggagaaagcttaccatggaaacatacgtaaacaaactacacgaaggatccacatacacagcagcagtacaatacaacgtactagaaaaagacgacgacccagcatctttaaccatatgggtaccaatgttccaatcatcaatgccagcagacctcttaataaaagaactagcaaacgtaaacatcctagtcaaacaaatatcaacacccaaaggaccatccctcagagtaatgatcaactcaagatcagcagtactagcacaaatgccatcaaaattcacaatatgcgccaacgtttctttagacgaacgatcaaaattagcctacgacgtaacaacaccctgcgaaataaaagcatgctcactaacatgcctaaaatcaaaaaacatgctcactacagtaaaagacctaaccatgaaaacactcaacccaacacacgacataatagccctatgcgaatttgaaaacatagtaacatcaaaaaaagtaataatcccaacatacttaagatcgatctcagtcagaaacaaagacctaaatacactcgaaaacataacaacaacagaatttaaaaacgcaataacaaacgcaaaaataataccatactcaggactactcctagtaataacagtaacagacaacaaaggagcattcaaatacataaaaccacaatcacaattcatcgtagacctcggagcatacctagaaaaagaatcaatatactacgtaacaacaaactggaaacacaccgccacaagattcgcaataaaacccatggaagactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10052 - RNA, 988 nt, synthetic construct
  misc_feature 1..988: note = mRNA product Design i-3 comprising derived and/or modified sequence from HRSV(A2)__P0DOE7.1__M (opt11)
  source 1..988: mol_type = other RNA
gggagaaagcttaccatggaaacctacgtcaacaaactacacgaaggctcaacctacaccgccgccgtccaatacaacgtcctcgaaaaagacgacgaccccgcctccctaaccatctgggttcccatgttccaatcatccatgcccgccgacctcctcataaaagaactagccaacgtcaacatcctagtcaaacaaatcagcacccccaaaggcccctccctccgcgtaatgatcaactcccgctccgccgtcctagcccaaatgccctccaaatttacaatctgcgccaacgtctccctcgacgaacgctcaaaactcgcctacgacgtcaccacaccctgcgaaatcaaagcctgctccctcacctgcctcaaaagcaaaaatatgctaaccaccgtcaaagaccttaccatgaaaaccctcaaccccactcacgacatcatagccctctgcgaatttgaaaacatcgtcacctccaaaaaagtcatcatccccacatacctccgctccatctccgtccgcaacaaagacctcaacaccctcgaaaacatcaccaccaccgaatttaaaaacgccatcaccaacgccaaaatcatcccctactccggcctcctcctcgtcatcaccgttaccgacaacaaaggcgccttcaaatacatcaaaccccaatcccaattcatcgtcgacctcggagcctaccttgaaaaagagtccatctactacgtcaccaccaactggaaacacaccgccacccgattcgccatcaaacccatggaagactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10053 - protein, 256 aa, synthetic construct; identical to SEQ ID NO: 9684
  REGION 1..256: note = derived and/or modified protein sequence (wt) from HRSV(Memphis-37)__AIY60638.1__M

SEQ ID NO: 10054 - protein, 256 aa, synthetic construct
  REGION 1..256: note = derived and/or modified protein sequence (wt) from HRSV__O42049.1__M
METYVNKLHEGSTYTAAVQYNVLEKDDDPASLTIWVPMFQSSVPADLLIKELASINILVKQISTPKGPSLRVTINSRSAVLAQMPSNFIISANVSLDERSKLAYDVTTPCEIKACSLTCLKVKSMLTTVKDLTMKTFNPTHEIIALCEFENIMTSKRVIIPTYLRPISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10055 - protein, 256 aa, synthetic construct
  REGION 1..256: note = derived and/or modified protein sequence (wt) from HRSV__AAR14263.1__M
METYVNKLHEGSTYTAAVQYNVLEKDDDPASLTIWVPMFQSSVPADLLIKELASINILVKQISTPKGPSLRVTINSRSAVLAQMPSNFIISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10056 - protein, 256 aa, synthetic construct
  REGION 1..256: note = derived and/or modified protein sequence (wt) from HRSV__AAX23991.1__M
METYVNKLHEGSTYTAAVQYNVLEKDDDPASLTIWVPMFQSSMPADLLIKELANVNILVKQISTPKGPSLRVMINSRSALLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10057 - protein, 256 aa, synthetic construct
  REGION 1..256: note = derived and/or modified protein sequence (wt) from HRSV__AEQ63375.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDITTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10058 - protein, 256 aa, synthetic construct
  REGION 1..256: note = derived and/or modified protein sequence (wt) from HRSV__AEQ63408.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKRVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10059 - protein, 256 aa, synthetic construct
  REGION 1..256: note = derived and/or modified protein sequence (wt) from HRSV__AEQ63441.1__M
METYVNKLHEGSTYTAAVQYNVLEKDDDPASLTIWVPMFQSSMPADSLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10060 - protein, 256 aa, synthetic construct
  REGION 1..256: note = derived and/or modified protein sequence (wt) from HRSV__AEQ63517.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVBLGAYLEKESIYYVTTNWKHTATRFAIKPMED

SEQ ID NO: 10061 - protein, 256 aa, synthetic construct
  REGION 1..256: note = derived and/or modified protein sequence (wt) from HRSV__AEQ63583.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10062 - protein, 256 aa, synthetic construct
  REGION 1..256: note = derived and/or modified protein sequence (wt) from HRSV__AFM55219.1__M
METYVNKLHEGSTYTAAVQYNVLEKDDDPASLTIWVPMFQSSMSADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISIRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10063 - protein, 256 aa, synthetic construct
  REGION 1..256: note = derived and/or modified protein sequence (wt) from HRSV__AFM55516.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKIIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10064 - protein, 256 aa, synthetic construct
  REGION 1..256: note = derived and/or modified protein sequence (wt) from HRSV__AFM55549.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPIED

SEQ ID NO: 10065 - protein, 256 aa, synthetic construct
  REGION 1..256: note = derived and/or modified protein sequence (wt) from HRSV__AFM95387.1__M
METYVNKLHEGSTYTAAVQYNVLEKDDDPASLTIWVPMFQSSMPADLLIKELANVNILVKQISTPKGPSLRVMINSRSAMLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10066 - protein, 256 aa, synthetic construct
  REGION 1..256: note = derived and/or modified protein sequence (wt) from HRSV__AGN28503.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIRPLED

SEQ ID NO: 10067 - protein, 256 aa, synthetic construct
  REGION 1..256: note = derived and/or modified protein sequence (wt) from HRSV__AGN28525.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKTFNPTHEIIALCEFENIMTSKKVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10068 - protein, 256 aa, synthetic construct
  REGION 1..256: note = derived and/or modified protein sequence (wt) from HRSV__AGN28547.1__M
METYVNKLHEGSTYTAAVQYNVLEKDDDPASLTIWVPMFQSSVPADLLIKELASINILVKQISTPKGPSLRVTINSRSAVLAQMPSNFIISANVSLDERSKLAYDVTTPCEIKACSLTCLKVKSMLTTVKDLTMKTFNPTHEIIALCEFENIMTSKRIIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10069 - protein, 256 aa, synthetic construct
  REGION 1..256: note = derived and/or modified protein sequence (wt) from HRSV__AGN28679.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLPYDVTTPCEIKACSLTCLKVKSMLTTVKDLTMKTFNPTHEIIALCEFENSMPSKRVVIPTYIRSISLKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10070 - protein, 256 aa, synthetic construct
  REGION 1..256: note = derived and/or modified protein sequence (wt) from HRSV__AGN92845.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSINVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10071 - protein, 256 aa, synthetic construct
  REGION 1..256: note = derived and/or modified protein sequence (wt) from HRSV__AGT75332.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAHLEKESIYYVTTNWKHTATRFAIKPMED

SEQ ID NO: 10072 - protein, 256 aa, synthetic construct
  REGION 1..256: note = derived and/or modified protein sequence (wt) from HRSV__AHA83627.1__M
METYVNKLHEGSTYTAAVQYNVLEKDDDPASLTIWVPMFQSSMPADLLIKELANVNILVKQISTPKGPSLRVMINSRSAVLAQMPSKFTISANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10073 - protein, 256 aa, synthetic construct
  REGION 1..256: note = derived and/or modified protein sequence (wt) from HRSV__AHA83757.1__M
METYVNKLHEGSTYTAAVQYNVLEKDDDPASLTIWVPMFQSSMPADQLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10074 - protein, 256 aa, synthetic construct
  REGION 1..256: note = derived and/or modified protein sequence (wt) from HRSV__AHA83921.1__M
METYVNKLHEGSTYTAAVQYNVLEKDDNPASLTIWVPMFQSSVPADLLIKELASINILVKQISTPKGPSLRVTINSRSAVLAQMPSNFIISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10075 - protein, 256 aa, synthetic construct
  REGION 1..256: note = derived and/or modified protein sequence (wt) from HRSV__AHA84064.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKAFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10076 - protein, 256 aa, synthetic construct
  REGION 1..256: note = derived and/or modified protein sequence (wt) from HRSV__AHJ60040.1__M
METYVNKLHEGSTYTAAVQYNVLEKDDDPASLTIWVPMFQSSVPADLLIKELASINILVKQISTPTGPSLRVTINSRSAVLAQMPSNFIISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10077 - protein, 256 aa, synthetic construct
  REGION 1..256: note = derived and/or modified protein sequence (wt) from HRSV__AHW80767.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCKFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10078 - protein, 256 aa, synthetic construct
  REGION 1..256: note = derived and/or modified protein sequence (wt) from HRSV__AHW80797.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENVTTTEFKNAITNAKIIPYSGLLLVITVTDNKGAFKYIKPQSQFIVDLGAYLEKESIYYVTTNWKHTATRFAIKPMED

SEQ ID NO: 10079 - protein, 256 aa, synthetic construct
  REGION 1..256: note = derived and/or modified protein sequence (wt) from HRSV__AHW80987.1__M
METYVNKLHEGSTYTAAVQYNVLEKDDDPASLTIWVPMFQSSMPADSLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVTIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10080 - protein, 256 aa, synthetic construct
  REGION 1..256: note = derived and/or modified protein sequence (wt) from HRSV__AHW81377.1__M
METYVNKLHEGSTYTAAVQYNVLEKDDDPASLTIWVPMFQSSIPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10081 - protein, 256 aa, synthetic construct
  REGION 1..256: note = derived and/or modified protein sequence (wt) from HRSV__AHW81387.1__M
METYVNKLHEGSTYTAAVQYNVLEKDDDPASLTIWVPMFQSSIPADLLIKELANVNILVKQISTPKGPSLRIMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10082 - protein, 256 aa, synthetic construct
  REGION 1..256: note = derived and/or modified protein sequence (wt) from HRSV__AHX57072.1__M
METYVNKLHEGSTYTAAVQYNVLEKDDDPASLTIWVPMFQSSIPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLSTLENITTTEFKNAITNAKIIPYSGLLLVITVTDNKGAFKYIKPQSQFIVDLGAYLEKESIYYVTTNWKHTATRFAIKPMED

SEQ ID NO: 10083 - protein, 256 aa, synthetic construct
  REGION 1..256: note = derived and/or modified protein sequence (wt) from HRSV__AHY21394.1__M
METYVNKLHEGSTYTAAVQYNVLEKDDDPASLTIWVPMFQSSVPADLLIKELASINILVKQISTPKGPSLRVTINSRSAVLAQMPSNFIISANVSLDERSKLAYDVTTPCEIKACSLTCLKVKSMLTTVKDLTMKTFNPTHEIIALCEFENIMTSKKVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10084 - protein, 256 aa, synthetic construct
  REGION 1..256: note = derived and/or modified protein sequence (wt) from HRSV__AIA63191.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALSDVENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10085 - protein, 256 aa, synthetic construct
  REGION 1..256: note = derived and/or modified protein sequence (wt) from HRSV__AIY70195.1__M
METYVNKLHEGSTYTAAVQYNVLEKDDDPASLTIWVPMFQSSMPADLLIKELANVNILVKQISTLKGPSLRVMINSRSAVLAQMPSKFTICANVSLDERSKLAYDVTTPCEIKACSLTCLKSENMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10086 - protein, 256 aa, synthetic construct
  REGION 1..256: note = derived and/or modified protein sequence (wt) from HRSV__AIY70239.1__M
METYVNKLHEGSTYTAAVQYNVLEKDDDPASLTIWVPMFQSSMPADLLIKELANVNILVKQISTLKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10087 - protein, 256 aa, synthetic construct
  REGION 1..256: note = derived and/or modified protein sequence (wt) from HRSV__AIZ95978.1__M
METYVNKLHEGSTYTAAVQYNVLEKDDDPASLTIWVPMFQSSMPADLLIKELANVSILVKQISTPKGPSLRVMINSRSAVLAQMPSKFTISANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10088 - protein, 256 aa, synthetic construct
  REGION 1..256: note = derived and/or modified protein sequence (wt) from HRSV__AIZ96022.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKTFNPTHEIIALCEFENIMTSKSVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10089 - protein, 256 aa, synthetic construct
  REGION 1..256: note = derived and/or modified protein sequence (wt) from HRSV__AJF44523.1__M
METYVNKLHEGSTYTAAVQYNVLEKDDDPASLTIWVPMFQSSVPADLLIKELASINILVKQISTPKGPSLRVTINSRSAVLAQMPSSFIISANVSLDERSKLAYDVTTPCEIKACSLTCLKVKSMLTTVKDLTMKTFNPTHEIIALCEFENIMTSKKVIIPTYLRSISVKNKDLNSLENIATTEFKNAITNAKIIPYAGLVLVITVTDNKGAFKFIKPQSQFIVDLGAYLEKESIYYVTTNWKHTATRFSIKPLED

SEQ ID NO: 10090 - protein, 256 aa, synthetic construct
  REGION 1..256: note = derived and/or modified protein sequence (wt) from HRSV__AJF44599.1__M
METYVNKLHEGSTYTAAVQYNVLEKDDDPASLTIWVPMFQSSVPADLLIKELANINILVKQISTPKGPSLRVTINSRSAVLAQMPSNFTISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10091 - protein, 256 aa, synthetic construct
  REGION 1..256: note = derived and/or modified protein sequence (wt) from HRSV__AJF44700.1__M
METYVNKLHEGSTYTAAVQYNVLEKDDDPASLTIWVPMFQSSVPADLLIKELASINILVKQISTPKGPSLRVTINSRSAVLAQMPSSFTISANVSLDERSKLAYDVTTPCEIKACSLTCLKVKSMLTTVKDLTMKTFNPTHEIIALCEFENIMTSKKVIIPTYLRSISVKNKDLNSLENIATTEFKNAITNAKIIPYAGLVLVITVTDNKGAFKFIKPQSQFIVDLGAYLEKESIYYVTTNWKHTATRFSIKPLED

SEQ ID NO: 10092 - protein, 256 aa, synthetic construct
  REGION 1..256: note = derived and/or modified protein sequence (wt) from HRSV__AJF44768.1__M
METYVNKLHEGSTYTAAVQYNVLEKDDDPASLTIWVPMFQSSMPADLLIKELANVNILVKQISTPKGPSLRVMINSRSAVLVQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10093 - protein, 256 aa, synthetic construct
  REGION 1..256: note = derived and/or modified protein sequence (wt) from HRSV__AJZ69877.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKNLNTLENITTTEFKNAITNAKIIPYSGLLLVITVTDNKGAFKYIKPQSQFIVDLGAYLEKESIYYVTTNWKHTATRFAIKPMED

SEQ ID NO: 10094 - protein, 256 aa, synthetic construct
  REGION 1..256: note = derived and/or modified protein sequence (wt) from HRSV__AKA45857.1__M
METYVNKLHEGSTYTAAVQYNILEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10095 - protein, 256 aa, synthetic construct
  REGION 1..256: note = derived and/or modified protein sequence (wt) from HRSV__AMA66379.1__M
METYVNKLHEGSTYTAAVQYNVLEKDDDPASLTIWVPMFQSSVPADLLIKELASINILVKQISTPKGPSLRVTINSRSAVLAQMPSNFIISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHIATRFSIKPLED

SEQ ID NO: 10096 - protein, 256 aa, synthetic construct
  REGION 1..256: note = derived and/or modified protein sequence (wt) from HRSV__AMA66401.1__M
METYVNKLHEGSTYTAAVQYNVLEKDDDPASLTIWVPMFQSSMSADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10097 - protein, 256 aa, synthetic construct
  REGION 1..256: note = derived and/or modified protein sequence (wt) from HRSV__AMA66665.1__M
METYVNKLHEGSTYTAAVQYNVLEKDDDPASLTIWVPMFQSSMPADSLIKELANVNILVKQISTPKGPSLRVMINSRSAVLAQMPSKFTISANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10098 - protein, 256 aa, synthetic construct
  REGION 1..256: note = derived and/or modified protein sequence (wt) from HRSV__AMA66995.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYITTNWKHTATRFAIKPMED

SEQ ID NO: 10099 - protein, 256 aa, synthetic construct
  REGION 1..256: note = derived and/or modified protein sequence (wt) from HRSV__AMT77696.1__M
METYVNKLHEGSTYTAAVQYNVLEKDDDPASLTIWVPMFQSSVPADLLIKELASISILVKQISTPKGPSLRVTINSRSAVLAQMPSNFTISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10100 - protein, 256 aa, synthetic construct
  REGION 1..256: note = derived and/or modified protein sequence (wt) from HRSV__AMT78378.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKTFNPTHEIIALCEFENIVTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10101 - protein, 256 aa, synthetic construct
  REGION 1..256: note = derived and/or modified protein sequence (wt) from HRSV__ANZ80064.1__M
METYVNKLHEGSTYTAAVQYNVLEKDDDPASLTIWVPMFQSSVPADLLIKELASINILVKQISTPKGPSLRVTINSRSAVLAQMPSSFTISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10102 - protein, 256 aa, synthetic construct
  REGION 1..256: note = derived and/or modified protein sequence (wt) from HRSV__ANZ80075.1__M
METYVNKLHEGSTYTAAVQYNVLEKDDDPASLTIWVPMFQSSMPADLLIKELANVNILVKQISTTKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10103 - protein, 256 aa, synthetic construct
  REGION 1..256: note = derived and/or modified protein sequence (wt) from HRSV__ANZ80152.1__M
METYVNKLHEGSTYTAAVQYNVLEKDDDPASLTIWVPMFQSSMPADLLIKELANVNILVKQISTSKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10104 - protein, 256 aa, synthetic construct
  REGION 1..256: note = derived and/or modified protein sequence (wt) from HRSV__ANZ80196.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIATSKRVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10105 - protein, 256 aa, synthetic construct
  REGION 1..256: note = derived and/or modified protein sequence (wt) from HRSV__ANZ80306.1__M
METYVNKLHEGSTYTAAVQYNVLEKDNDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10106 - protein, 256 aa, synthetic construct
  REGION 1..256: note = derived and/or modified protein sequence (wt) from HRSV__ANZ80515.1__M
METYVNKLHEGSTYTAAVQYNVLEKDDDPASLTIWVPMFQSSMPADLLVKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKRVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10107 - protein, 256 aa, synthetic construct
  REGION 1..256: note = derived and/or modified protein sequence (wt) from HRSV__AOS48207.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIITSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10108 - protein, 256 aa, synthetic construct
  REGION 1..256: note = derived and/or modified protein sequence (wt) from HRSV__AOS48306.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVKNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10109 - protein, 256 aa, synthetic construct
  REGION 1..256: note = derived and/or modified protein sequence (wt) from HRSV__AOS48405.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKTFNPTHEIIALCEFENIMTSKRVTIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10110 - protein, 256 aa, synthetic construct
  REGION 1..256: note = derived and/or modified protein sequence (wt) from HRSV__AOY38332.1__M
METYVNKLHEGSTYTAAVQYNVLEKDDDPASLTIWVPMFQSSMPADLLIKELANVNILVKQISTPKGPSLRVMINSRSALLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVIDNKGAFKYIKPQSQFIVDLGAYLEKESIYYVTTNWKHTATRFAIKPMED

SEQ ID NO: 10111 - protein, 256 aa, synthetic construct
  REGION 1..256: note = derived and/or modified protein sequence (wt) from HRSV__APW78666.1__M
METYVNKLHEGSTYTAAVQYNVLEKDDDPASLTIWVPMFQSSVPADLLIKELASINILVKQISTSKGPSLRVTINSRSAVLAQMPSNFIISANVSLDERSKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10112 - protein, 256 aa, synthetic construct
  REGION 1..256: note = derived and/or modified protein sequence (wt) from HRSV__APW78699.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKTFKPTHEIIALCEFENTMTSKRVTIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10113 - protein, 256 aa, synthetic construct
  REGION 1..256: note = derived and/or modified protein sequence (wt) from HRSV__APW78908.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERSKLAYDVTTPCEIKACSLTCLKVKSMLTTVKDLTMKTFNPTHEIIALCEFENIRTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10114 - protein, 256 aa, synthetic construct
  REGION 1..256: note = derived and/or modified protein sequence (wt) from HRSV__ARB66380.1__M
METYVNKLHEGSTYTAAVQYNVLEKDDDPASLTIWVPMFQSTMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10115 - protein, 256 aa, synthetic construct
  REGION 1..256: note = derived and/or modified protein sequence (wt) from HRSV__ARB66413.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNANTNAKIIPYSGLLLVITVTDNKGAFKYIKPQSQFIVDLGAYLEKESIYYVTTNWKHTATRFAIKPMED

SEQ ID NO: 10116 - protein, 256 aa, synthetic construct
  REGION 1..256: note = derived and/or modified protein sequence (wt) from HRSV__ARB66446.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNGKHTGTRFAIKPMED

SEQ ID NO: 10117 - protein, 256 aa, synthetic construct
  REGION 1..256: note = derived and/or modified protein sequence (wt) from HRSV__ARN61504.1__M
METYVNKLHEGSTYTAAVQYNVLEKDDDPASLTIWVPMFQSSMPADLLIKELANVNILVKQISTPKGPSLRVMINSRSALLAQMPSKFTICANVSLDERSKLAYDVTTPCEIKACSLTCLKSKNMLTTVKDLTMKTLNPTHDIIALCEFENIVASKKVIIPTYLRSISVRNKDLNTLENITTTEFKNAITNAKIIPYSGLLLVITVTDNKGAFKYIKPQSQFIVDLGAYLEKESIYYVTTNWKHTATRLAIKPMED

SEQ ID NO: 10118 - protein, 256 aa, synthetic construct
  REGION 1..256: note = derived and/or modified protein sequence (wt) from HRSV__ARQ15952.1__M
METYVNKLHEGSTYTAAVQYNVLEKDDDPASLTIWVPMFQSSIPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEEESIYYVTTNWKHTATRFAIKPMED

SEQ ID NO: 10119 - protein, 256 aa, synthetic construct
  REGION 1..256: note = derived and/or modified protein sequence (wt) from HRSV__ART28380.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLSTLENITTTEFKNAITNAKIIPYSGLLLVITVTDNKGAFKYIKPQSQFIVDLGAYLEKESIYYVTTNWKHTATRFAIKPMED

SEQ ID NO: 10120 - protein, 256 aa, synthetic construct
  REGION 1..256: note = derived and/or modified protein sequence (wt) from HRSV__ART28424.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTSCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10121 - protein, 256 aa, synthetic construct
  REGION 1..256: note = derived and/or modified protein sequence (wt) from HRSV__ASL69314.1__M
METYVNKLHEGSTYTAAVQYNVLEKDDDPASLTIWVPMFQSSIPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWRHTATRFAIKPMED

SEQ ID NO: 10122 - protein, 256 aa, synthetic construct
  REGION 1..256: note = derived and/or modified protein sequence (wt) from HRSV__ASL69346.1__M
METYVNKLHEGSTYTAAVQYNVLEKDDDPASLTIWVPMFQSSVPADLLIKELASINILVKQISTPKGPSLRVTINSRSAVLAQMPSNFIISANVSLDERSKLAYDVTTPCEIKACSLTCLKVKSMLTTVKDLTMKTFNPTHEIIALCEFENIMTSKRVIIPTYLRSIGVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10123 - protein, 256 aa, synthetic construct
  REGION 1..256: note = derived and/or modified protein sequence (wt) from HRSV__ASL69350.1__M
METYVNKLHEGSTYTAAVQYNVLEKDDDPASLTIWVPMFQSSVPADLLIKELASINILVKQISTPKGPSLRVTINSRSAVLAQMPSNFTISANVSLDERGKLAYDVTTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10124 - protein, 256 aa, synthetic construct
  REGION 1..256: note = derived and/or modified protein sequence (wt) from HRSV__ASV49529.1__M
METYVNKLHEGSTYTAAVQYNVLEKDDDPASLTIWVPMFQSSMPADLLIKELANVNILVKQISTPKGPSLKVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10125 - protein, 256 aa, synthetic construct
  REGION 1..256: note = derived and/or modified protein sequence (wt) from HRSV__ATV81351.1__M
METYVNKLPYVSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10126 - protein, 256 aa, synthetic construct
  REGION 1..256: note = derived and/or modified protein sequence (wt) from HRSV__AUC68267.1__M
METYVNKLHEGSTYTAAVQYNVLEKDDDPASLTIWVPMFQSSVPADLLIKELASINILVKQISTPKGPSLRVTINSRSAVLAQMPSNFIISANVSLDERSKLAYDITTPCEIKACSLTCLKVKSMLTTVKDLTMKTFNPTHEIIALCEFENIMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10127 - protein, 256 aa, synthetic construct
  REGION 1..256: note = derived and/or modified protein sequence (wt) from HRSV__AUC68332.1__M
METYVNKLHEGSTYTAAVQYNVLEKDDDPASLTIWVPMFQSSMPADLLIKELANVNILVKQISTPKGPSLRVMINSRSAVLAQMPSKFTICANVSLDERSKLAYDVTTPCEIKACSLTCLKSKNMLTTVKDLTMKPLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10128 - protein, 256 aa, synthetic construct
  REGION 1..256: note = derived and/or modified protein sequence (wt) from HRSV__AUC68343.1__M
METYVNKLHEGSTYTAAVQYNVLEKDDDPASLTIWVPMFQSSVPADLLIKELASINILVKQISTPKGPSLRVTINSRSAVLAQMPSNFIISANVSLDERSKLAYDVTTPCEIKACSLTCLKVKSMLTTVKDLTMKTFNPTHEIIALCEFENTMTSKRVIIPTYLRSISVKNKDLNSLENIATTEFKNAITNAKIIPYAGLVLVITVTDNKGAFKYIKPQSQFIVDLGAYLEKESIYYVTTNWKHTATRFSIKPLED

SEQ ID NO: 10129 - protein, 256 aa, synthetic construct
  REGION 1..256: note = derived and/or modified protein sequence (wt) from HRSV__NP_044593.1__M
METYVNKLHEGSTYTAAVQYNVLEKDDDPASLTIWVPMFQSSMPADLLIKELANVNILVKQISTPNGPSLRVMINSRSAVLAQMPSKFTICANVSLDERSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10130 - protein, 256 aa, synthetic construct
  REGION 1..256: note = derived and/or modified protein sequence (wt) from HRSV__P24615.1__M
METYVNKLHEGSIYTAAVQYNVIEKDDDPASLTIWVPMFQSSISADMLIKELINVNILVRQISTPKGPSLKIMINSRSAVLAQMPSKFTISANVSLDERSKLAYDITTPCEIKACSLTCLKVKNMLTTVKDLTMKTFNPTHEIIALCEFENIMTSKRVVIPTFLRSINVKAKDLDSLENIATTEFKNAITNAKIIPYAGLVLVITVTDNKGAFKYIKPQSQFIVDLGAYLEKESIYYVTTNWKHTATKFSIKPIED

SEQ ID NO: 10131 - protein, 256 aa, synthetic construct
  REGION 1..256: note = derived and/or modified protein sequence (wt) from HRSV__Q84131.1__M
METYVNKLHEGSTYTAAVQYNVLEKDDDPASLTIWVPMFQSSISADLLIKELINVNILVRQISTLKGPSLKIMINSRSAVLAQMPNKFTISANVSLDERSKLAYDITTPCEIKACSLTCLKVKNMLTTVKDLTMKTFNPTHEIIALCEFENIMTSKKVVIPTFLRSINVKAKDLDSLENIATTEFKNAITNAKIIPYAGLVLVITVTDNKGAFKYIKPQSQFIVDLGAYLEKESIYYVTTNWKHTATRFSIKPIED

SEQ ID NO: 10132 - protein, 256 aa, synthetic construct
  REGION 1..256: note = derived and/or modified protein sequence (wt) from HRSV__2VQP_A__M
METYVNKLHEGSTYTAAVQYNVLEKDDDPASLTIWVPMFQSSMPADLLIKELANVNILVKQISTPKGPSLRVMINSRSAVLAQMPSKFTICANVSLDDRSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPRED

SEQ ID NO: 10133 - protein, 256 aa, synthetic construct
  REGION 1..256: note = derived and/or modified protein sequence (wt) from HRSV__2YKD_A__M
METYVNKLHEGSTYTAAVQYNVLEKDDDPASLTIWVPMFQSSMPADLLIKELANVNILVKQISTPKGPSLRVMINSRSAVLAQMPSKFTICANVSLDDRSKLAYDVTTPCEIKACSLTCLKSKNMLTTVKDLTMKTLNPTHDIIALCEFENIVTSKKVIIPTYLRSISVRNKDLNTLENITTTEFKNAITNAKIIPYSGLLLVITVTDNKGAFKYIKPQSQFIVDLGAYLEKESIYYVTTNWKHTATRFAIKPMED

SEQ ID NO: 10134 - protein, 391 aa, synthetic construct
  REGION 1..391: note = derived and/or modified protein sequence (wt) from HRSV(A2)__P03418.1__N
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELEAIKHQLNPKDNDVEL

SEQ ID NO: 10135 - RNA, 1176 nt, synthetic construct
  misc_feature 1..1176: note = derived and/or modified CDS sequence (wt) from HRSV(A2)__P03418.1__N
  source 1..1176: mol_type = other RNA
atggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttga

SEQ ID NO: 10136 - RNA, 1176 nt, synthetic construct
  misc_feature 1..1176: note = derived and/or modified CDS sequence (opt1) from HRSV(A2)__P03418.1__N
  source 1..1176: mol_type = other RNA
atggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctga

SEQ ID NO: 10137 - RNA, 1176 nt, synthetic construct
  misc_feature 1..1176: note = derived and/or modified CDS sequence (opt2) from HRSV(A2)__P03418.1__N
  source 1..1176: mol_type = other RNA
atggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctga

SEQ ID NO: 10138 - RNA, 1176 nt, synthetic construct
  misc_feature 1..1176: note = derived and/or modified CDS sequence (opt3) from HRSV(A2)__P03418.1__N
  source 1..1176: mol_type = other RNA
atggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttga

SEQ ID NO: 10139 - RNA, 1176 nt, synthetic construct
  misc_feature 1..1176: note = derived and/or modified CDS sequence (opt4) from HRSV(A2)__P03418.1__N
  source 1..1176: mol_type = other RNA
atggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtga

SEQ ID NO: 10140 - RNA, 1176 nt, synthetic construct
  misc_feature 1..1176: note = derived and/or modified CDS sequence (opt5) from HRSV(A2)__P03418.1__N
  source 1..1176: mol_type = other RNA
atggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttga

SEQ ID NO: 10141 - RNA, 1176 nt, synthetic construct
  misc_feature 1..1176: note = derived and/or modified CDS sequence (opt6) from HRSV(A2)__P03418.1__N
  source 1..1176: mol_type = other RNA
atggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataa

SEQ ID NO: 10142 - RNA, 1176 nt, synthetic construct
  misc_feature 1..1176: note = derived and/or modified CDS sequence (opt11) from HRSV(A2)__P03418.1__N
  source 1..1176: mol_type = other RNA
atggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataa

SEQ ID NO: 10143 - RNA, 1452 nt, synthetic construct
  misc_feature 1..1452: note = mRNA product Design a-1 comprising derived and/or modified sequence from HRSV(A2)__P03418.1__N (wt)
  source 1..1452: mol_type = other RNA
gggagagtcccgcagtcggcgtccagcggctctgcttgttcgtgtgtgtgtcgttgcaggccttattcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10144 - RNA, 1452 nt, synthetic construct
  misc_feature 1..1452: note = mRNA product Design a-1 comprising derived and/or modified sequence from HRSV(A2)__P03418.1__N (opt1)
  source 1..1452: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10145 - RNA, 1452 nt, synthetic construct
  misc_feature 1..1452: note = mRNA product Design a-1 comprising derived and/or modified sequence from HRSV(A2)__P03418.1__N (opt2)
  source 1..1452: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10146 - RNA, 1452 nt, synthetic construct
  misc_feature 1..1452: note = mRNA product Design a-1 comprising derived and/or modified sequence from HRSV(A2)__P03418.1__N (opt3)
  source 1..1452: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10147 - RNA, 1452 nt, synthetic construct
  misc_feature 1..1452: note = mRNA product Design a-1 comprising derived and/or modified sequence from HRSV(A2)__P03418.1__N (opt4)
  source 1..1452: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10148 - RNA, 1452 nt, synthetic construct
  misc_feature 1..1452: note = mRNA product Design a-1 comprising derived and/or modified sequence from HRSV(A2)__P03418.1__N (opt5)
  source 1..1452: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10149 - RNA, 1452 nt, synthetic construct
  misc_feature 1..1452: note = mRNA product Design a-1 comprising derived and/or modified sequence from HRSV(A2)__P03418.1__N (opt6)
  source 1..1452: mol_type = other RNA
gggagagtcccgcagtcggcgtccagcggctctgcttgttcgtgtgtgtgtcgttgcaggccttattcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10150 - RNA, 1452 nt, synthetic construct
  misc_feature 1..1452: note = mRNA product Design a-1 comprising derived and/or modified sequence from HRSV(A2)__P03418.1__N (opt11)
  source 1..1452: mol_type = other RNA
gggagagtcccgcagtcggcgtccagcggctctgcttgttcgtgtgtgtgtcgttgcaggccttattcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10151 - RNA, 1471 nt, synthetic construct
  misc_feature 1..1471: note = mRNA product Design a-2 comprising derived and/or modified sequence from HRSV(A2)__P03418.1__N (wt)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10152 - RNA, 1471 nt, synthetic construct
  misc_feature 1..1471: note = mRNA product Design a-2 comprising derived and/or modified sequence from HRSV(A2)__P03418.1__N (opt1)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10153 - RNA, 1471 nt, synthetic construct
  misc_feature 1..1471: note = mRNA product Design a-2 comprising derived and/or modified sequence from HRSV(A2)__P03418.1__N (opt2)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10154 - RNA, 1471 nt, synthetic construct
  misc_feature 1..1471: note = mRNA product Design a-2 comprising derived and/or modified sequence from HRSV(A2)__P03418.1__N (opt3)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10155 - RNA, 1471 nt, synthetic construct
  misc_feature 1..1471: note = mRNA product Design a-2 comprising derived and/or modified sequence from HRSV(A2)__P03418.1__N (opt4)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10156 - RNA, 1471 nt, synthetic construct
  misc_feature 1..1471: note = mRNA product Design a-2 comprising derived and/or modified sequence from HRSV(A2)__P03418.1__N (opt5)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10157 - RNA, 1471 nt, synthetic construct
  misc_feature 1..1471: note = mRNA product Design a-2 comprising derived and/or modified sequence from HRSV(A2)__P03418.1__N (opt6)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10158 - RNA, 1471 nt, synthetic construct
  misc_feature 1..1471: note = mRNA product Design a-2 comprising derived and/or modified sequence from HRSV(A2)__P03418.1__N (opt11)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10159 - RNA, 1549 nt, synthetic construct
  misc_feature 1..1549: note = mRNA product Design a-3 comprising derived and/or modified sequence from HRSV(A2)__P03418.1__N (wt)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10160 - RNA, 1549 nt, synthetic construct
  misc_feature 1..1549: note = mRNA product Design a-3 comprising derived and/or modified sequence from HRSV(A2)__P03418.1__N (opt1)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10161 - RNA, 1549 nt, synthetic construct
  misc_feature 1..1549: note = mRNA product Design a-3 comprising derived and/or modified sequence from HRSV(A2)__P03418.1__N (opt2)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10162 - RNA, 1549 nt, synthetic construct
  misc_feature 1..1549: note = mRNA product Design a-3 comprising derived and/or modified sequence from HRSV(A2)__P03418.1__N (opt3)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10163 - RNA, 1549 nt, synthetic construct
  misc_feature 1..1549: note = mRNA product Design a-3 comprising derived and/or modified sequence from HRSV(A2)__P03418.1__N (opt4)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10164 - RNA, 1549 nt, synthetic construct
  misc_feature 1..1549: note = mRNA product Design a-3 comprising derived and/or modified sequence from HRSV(A2)__P03418.1__N (opt5)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10165 - RNA, 1549 nt, synthetic construct
  misc_feature 1..1549: note = mRNA product Design a-3 comprising derived and/or modified sequence from HRSV(A2)__P03418.1__N (opt6)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10166 - RNA, 1549 nt, synthetic construct
  misc_feature 1..1549: note = mRNA product Design a-3 comprising derived and/or modified sequence from HRSV(A2)__P03418.1__N (opt11)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10167 - RNA, 1498 nt, synthetic construct
  misc_feature 1..1498: note = mRNA product Design a-4 comprising derived and/or modified sequence from HRSV(A2)__P03418.1__N (wt)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10168 - RNA, 1498 nt, synthetic construct
  misc_feature 1..1498: note = mRNA product Design a-4 comprising derived and/or modified sequence from HRSV(A2)__P03418.1__N (opt1)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10169 - RNA, 1498 nt, synthetic construct
  misc_feature 1..1498: note = mRNA product Design a-4 comprising derived and/or modified sequence from HRSV(A2)__P03418.1__N (opt2)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10170 - RNA, 1498 nt, synthetic construct
  misc_feature 1..1498: note = mRNA product Design a-4 comprising derived and/or modified sequence from HRSV(A2)__P03418.1__N (opt3)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10171 - RNA, 1498 nt, synthetic construct
  misc_feature 1..1498: note = mRNA product Design a-4 comprising derived and/or modified sequence from HRSV(A2)__P03418.1__N (opt4)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10172 - RNA, 1498 nt, synthetic construct
  misc_feature 1..1498: note = mRNA product Design a-4 comprising derived and/or modified sequence from HRSV(A2)__P03418.1__N (opt5)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10173 - RNA, 1498 nt, synthetic construct
  misc_feature 1..1498: note = mRNA product Design a-4 comprising derived and/or modified sequence from HRSV(A2)__P03418.1__N (opt6)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10174 - RNA, 1498 nt, synthetic construct
  misc_feature 1..1498: note = mRNA product Design a-4 comprising derived and/or modified sequence from HRSV(A2)__P03418.1__N (opt11)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10175 - RNA, 1444 nt, synthetic construct
  misc_feature 1..1444: note = mRNA product Design a-5 comprising derived and/or modified sequence from HRSV(A2)__P03418.1__N (wt)
  source 1..1444: mol_type = other RNA
gggagactttcccattctgtagcagaatttggtgttgcctgtggtcttggtcccgcggagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10176 - RNA, 1444 nt, synthetic construct
  misc_feature 1..1444: note = mRNA product Design a-5 comprising derived and/or modified sequence from HRSV(A2)__P03418.1__N (opt1)
  source 1..1444: mol_type = other RNA
gggagactttcccattctgtagcagaatttggtgttgcctgtggtcttggtcccgcggagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10177 - RNA, 1444 nt, synthetic construct
  misc_feature 1..1444: note = mRNA product Design a-5 comprising derived and/or modified sequence from HRSV(A2)__P03418.1__N (opt2)
  source 1..1444: mol_type = other RNA
gggagactttcccattctgtagcagaatttggtgttgcctgtggtcttggtcccgcggagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10178 - RNA, 1444 nt, synthetic construct
  misc_feature 1..1444: note = mRNA product Design a-5 comprising derived and/or modified sequence from HRSV(A2)__P03418.1__N (opt3)
  source 1..1444: mol_type = other RNA
gggagactttcccattctgtagcagaatttggtgttgcctgtggtcttggtcccgcggagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10179 - RNA, 1444 nt, synthetic construct
  misc_feature 1..1444: note = mRNA product Design a-5 comprising derived and/or modified sequence from HRSV(A2)__P03418.1__N (opt4)
  source 1..1444: mol_type = other RNA
gggagactttcccattctgtagcagaatttggtgttgcctgtggtcttggtcccgcggagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10180 - RNA, 1444 nt, synthetic construct
  misc_feature 1..1444: note = mRNA product Design a-5 comprising derived and/or modified sequence from HRSV(A2)__P03418.1__N (opt5)
  source 1..1444: mol_type = other RNA
gggagactttcccattctgtagcagaatttggtgttgcctgtggtcttggtcccgcggagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10181 - RNA, 1444 nt, synthetic construct
  misc_feature 1..1444: note = mRNA product Design a-5 comprising derived and/or modified sequence from HRSV(A2)__P03418.1__N (opt6)
  source 1..1444: mol_type = other RNA
gggagactttcccattctgtagcagaatttggtgttgcctgtggtcttggtcccgcggagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10182 - RNA, 1444 nt, synthetic construct
  misc_feature 1..1444: note = mRNA product Design a-5 comprising derived and/or modified sequence from HRSV(A2)__P03418.1__N (opt11)
  source 1..1444: mol_type = other RNA
gggagactttcccattctgtagcagaatttggtgttgcctgtggtcttggtcccgcggagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10183 - RNA, 1625 nt, synthetic construct
  misc_feature 1..1625: note = mRNA product Design b-1 comprising derived and/or modified sequence from HRSV(A2)__P03418.1__N (wt)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10184 - RNA, 1625 nt, synthetic construct
  misc_feature 1..1625: note = mRNA product Design b-1 comprising derived and/or modified sequence from HRSV(A2)__P03418.1__N (opt1)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10185 - RNA, 1625 nt, synthetic construct
  misc_feature 1..1625: note = mRNA product Design b-1 comprising derived and/or modified sequence from HRSV(A2)__P03418.1__N (opt2)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10186 - RNA, 1625 nt, synthetic construct
  misc_feature 1..1625: note = mRNA product Design b-1 comprising derived and/or modified sequence from HRSV(A2)__P03418.1__N (opt3)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10187 - RNA, 1625 nt, synthetic construct
  misc_feature 1..1625: note = mRNA product Design b-1 comprising derived and/or modified sequence from HRSV(A2)__P03418.1__N (opt4)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10188 - RNA, 1625 nt, synthetic construct
  misc_feature 1..1625: note = mRNA product Design b-1 comprising derived and/or modified sequence from HRSV(A2)__P03418.1__N (opt5)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10189 - RNA, 1625 nt, synthetic construct
  misc_feature 1..1625: note = mRNA product Design b-1 comprising derived and/or modified sequence from HRSV(A2)__P03418.1__N (opt6)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10190 - RNA, 1625 nt, synthetic construct
  misc_feature 1..1625: note = mRNA product Design b-1 comprising derived and/or modified sequence from HRSV(A2)__P03418.1__N (opt11)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10191 - RNA, 1445 nt, synthetic construct
  misc_feature 1..1445: note = mRNA product Design b-2 comprising derived and/or modified sequence from HRSV(A2)__P03418.1__N (wt)
  source 1..1445: mol_type = other RNA
gggagagcctctgctggagtccggggagtggcgttggctgctagagcgaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10192 - RNA, 1445 nt, synthetic construct
  misc_feature 1..1445: note = mRNA product Design b-2 comprising derived and/or modified sequence from HRSV(A2)__P03418.1__N (opt1)
  source 1..1445: mol_type = other RNA
gggagagcctctgctggagtccggggagtggcgttggctgctagagcgaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10193 - RNA, 1445 nt, synthetic construct
  misc_feature 1..1445: note = mRNA product Design b-2 comprising derived and/or modified sequence from HRSV(A2)__P03418.1__N (opt2)
  source 1..1445: mol_type = other RNA
gggagagcctctgctggagtccggggagtggcgttggctgctagagcgaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10194 - RNA, 1445 nt, synthetic construct
  misc_feature 1..1445: note = mRNA product Design b-2 comprising derived and/or modified sequence from HRSV(A2)__P03418.1__N (opt3)
  source 1..1445: mol_type = other RNA
gggagagcctctgctggagtccggggagtggcgttggctgctagagcgaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10195 - RNA, 1445 nt, synthetic construct
  misc_feature 1..1445: note = mRNA product Design b-2 comprising derived and/or modified sequence from HRSV(A2)__P03418.1__N (opt4)
  source 1..1445: mol_type = other RNA
gggagagcctctgctggagtccggggagtggcgttggctgctagagcgaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10196 - RNA, 1445 nt, synthetic construct
  misc_feature 1..1445: note = mRNA product Design b-2 comprising derived and/or modified sequence from HRSV(A2)__P03418.1__N (opt5)
  source 1..1445: mol_type = other RNA
gggagagcctctgctggagtccggggagtggcgttggctgctagagcgaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10197 - RNA, 1445 nt, synthetic construct
  misc_feature 1..1445: note = mRNA product Design b-2 comprising derived and/or modified sequence from HRSV(A2)__P03418.1__N (opt6)
  source 1..1445: mol_type = other RNA
gggagagcctctgctggagtccggggagtggcgttggctgctagagcgaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10198 - RNA, 1445 nt, synthetic construct
  misc_feature 1..1445: note = mRNA product Design b-2 comprising derived and/or modified sequence from HRSV(A2)__P03418.1__N (opt11)
  source 1..1445: mol_type = other RNA
gggagagcctctgctggagtccggggagtggcgttggctgctagagcgaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10199 - RNA, 1465 nt, synthetic construct
  misc_feature 1..1465: note = mRNA product Design b-3 comprising derived and/or modified sequence from HRSV(A2)__P03418.1__N (wt)
  source 1..1465: mol_type = other RNA
gggagagtcccgcagtcggcgtccagcggctctgcttgttcgtgtgtgtgtcgttgcaggccttattcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10200 - RNA, 1465 nt, synthetic construct
  misc_feature 1..1465: note = mRNA product Design b-3 comprising derived and/or modified sequence from HRSV(A2)__P03418.1__N (opt1)
  source 1..1465: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10201 - RNA, 1465 nt, synthetic construct
  misc_feature 1..1465: note = mRNA product Design b-3 comprising derived and/or modified sequence from HRSV(A2)__P03418.1__N (opt2)
  source 1..1465: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10202 - RNA, 1465 nt, synthetic construct
  misc_feature 1..1465: note = mRNA product Design b-3 comprising derived and/or modified sequence from HRSV(A2)__P03418.1__N (opt3)
  source 1..1465: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10203 - RNA, 1465 nt, synthetic construct
  misc_feature 1..1465: note = mRNA product Design b-3 comprising derived and/or modified sequence from HRSV(A2)__P03418.1__N (opt4)
  source 1..1465: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10204 - RNA, 1465 nt, synthetic construct
  misc_feature 1..1465: note = mRNA product Design b-3 comprising derived and/or modified sequence from HRSV(A2)__P03418.1__N (opt5)
  source 1..1465: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10205 - RNA, 1465 nt, synthetic construct
  misc_feature 1..1465: note = mRNA product Design b-3 comprising derived and/or modified sequence from HRSV(A2)__P03418.1__N (opt6)
  source 1..1465: mol_type = other RNA
gggagagtcccgcagtcggcgtccagcggctctgcttgttcgtgtgtgtgtcgttgcaggccttattcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10206 - RNA, 1465 nt, synthetic construct
  misc_feature 1..1465: note = mRNA product Design b-3 comprising derived and/or modified sequence from HRSV(A2)__P03418.1__N (opt11)
  source 1..1465: mol_type = other RNA
gggagagtcccgcagtcggcgtccagcggctctgcttgttcgtgtgtgtgtcgttgcaggccttattcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10207 - RNA, 1516 nt, synthetic construct
  misc_feature 1..1516: note = mRNA product Design b-4 comprising derived and/or modified sequence from HRSV(A2)__P03418.1__N (wt)
  source 1..1516: mol_type = other RNA
gggagagtcccgcagtcggcgtccagcggctctgcttgttcgtgtgtgtgtcgttgcaggccttattcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10208 - RNA, 1516 nt, synthetic construct
  misc_feature 1..1516: note = mRNA product Design b-4 comprising derived and/or modified sequence from HRSV(A2)__P03418.1__N (opt1)
  source 1..1516: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10209 - RNA, 1516 nt, synthetic construct
  misc_feature 1..1516: note = mRNA product Design b-4 comprising derived and/or modified sequence from HRSV(A2)__P03418.1__N (opt2)
  source 1..1516: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10210 - RNA, 1516 nt, synthetic construct
  misc_feature 1..1516: note = mRNA product Design b-4 comprising derived and/or modified sequence from HRSV(A2)__P03418.1__N (opt3)
  source 1..1516: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10211 - RNA, 1516 nt, synthetic construct
  misc_feature 1..1516: note = mRNA product Design b-4 comprising derived and/or modified sequence from HRSV(A2)__P03418.1__N (opt4)
  source 1..1516: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10212 - RNA, 1516 nt, synthetic construct
  misc_feature 1..1516: note = mRNA product Design b-4 comprising derived and/or modified sequence from HRSV(A2)__P03418.1__N (opt5)
  source 1..1516: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10213 - RNA, 1516 nt, synthetic construct
  misc_feature 1..1516: note = mRNA product Design b-4 comprising derived and/or modified sequence from HRSV(A2)__P03418.1__N (opt6)
  source 1..1516: mol_type = other RNA
gggagagtcccgcagtcggcgtccagcggctctgcttgttcgtgtgtgtgtcgttgcaggccttattcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10214 - RNA, 1516 nt, synthetic construct
  misc_feature 1..1516: note = mRNA product Design b-4 comprising derived and/or modified sequence from HRSV(A2)__P03418.1__N (opt11)
  source 1..1516: mol_type = other RNA
gggagagtcccgcagtcggcgtccagcggctctgcttgttcgtgtgtgtgtcgttgcaggccttattcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10215 - RNA, 1578 nt, synthetic construct
  misc_feature 1..1578: note = mRNA product Design b-5 comprising derived and/or modified sequence from HRSV(A2)__P03418.1__N (wt)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10216 - RNA, 1578 nt, synthetic construct
  misc_feature 1..1578: note = mRNA product Design b-5 comprising derived and/or modified sequence from HRSV(A2)__P03418.1__N (opt1)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10217 - RNA, 1578 nt, synthetic construct
  misc_feature 1..1578: note = mRNA product Design b-5 comprising derived and/or modified sequence from HRSV(A2)__P03418.1__N (opt2)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10218 - RNA, 1578 nt, synthetic construct
  misc_feature 1..1578: note = mRNA product Design b-5 comprising derived and/or modified sequence from HRSV(A2)__P03418.1__N (opt3)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10219 - RNA, 1578 nt, synthetic construct
  misc_feature 1..1578: note = mRNA product Design b-5 comprising derived and/or modified sequence from HRSV(A2)__P03418.1__N (opt4)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10220 - RNA, 1578 nt, synthetic construct
  misc_feature 1..1578: note = mRNA product Design b-5 comprising derived and/or modified sequence from HRSV(A2)__P03418.1__N (opt5)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10221 - RNA, 1578 nt, synthetic construct
  misc_feature 1..1578: note = mRNA product Design b-5 comprising derived and/or modified sequence from HRSV(A2)__P03418.1__N (opt6)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10222 - RNA, 1578 nt, synthetic construct
  misc_feature 1..1578: note = mRNA product Design b-5 comprising derived and/or modified sequence from HRSV(A2)__P03418.1__N (opt11)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10223 - RNA, 1484 nt, synthetic construct
  misc_feature 1..1484: note = mRNA product Design c-1 comprising derived and/or modified sequence from HRSV(A2)__P03418.1__N (wt)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10224 - RNA, 1484 nt, synthetic construct
  misc_feature 1..1484: note = mRNA product Design c-1 comprising derived and/or modified sequence from HRSV(A2)__P03418.1__N (opt1)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10225 - RNA, 1484 nt, synthetic construct
  misc_feature 1..1484: note = mRNA product Design c-1 comprising derived and/or modified sequence from HRSV(A2)__P03418.1__N (opt2)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10226 - RNA, 1484 nt, synthetic construct
  misc_feature 1..1484: note = mRNA product Design c-1 comprising derived and/or modified sequence from HRSV(A2)__P03418.1__N (opt3)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10227 - RNA, 1484 nt, synthetic construct
  misc_feature 1..1484: note = mRNA product Design c-1 comprising derived and/or modified sequence from HRSV(A2)__P03418.1__N (opt4)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10228 - RNA, 1484 nt, synthetic construct
  misc_feature 1..1484: note = mRNA product Design c-1 comprising derived and/or modified sequence from HRSV(A2)__P03418.1__N (opt5)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10229 - RNA, 1484 nt, synthetic construct
  misc_feature 1..1484: note = mRNA product Design c-1 comprising derived and/or modified sequence from HRSV(A2)__P03418.1__N (opt6)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10230 - RNA, 1484 nt, synthetic construct
  misc_feature 1..1484: note = mRNA product Design c-1 comprising derived and/or modified sequence from HRSV(A2)__P03418.1__N (opt11)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10231 - RNA, 1574 nt, synthetic construct
  misc_feature 1..1574: note = mRNA product Design c-2 comprising derived and/or modified sequence from HRSV(A2)__P03418.1__N (wt)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10232 - RNA, 1574 nt, synthetic construct
  misc_feature 1..1574: note = mRNA product Design c-2 comprising derived and/or modified sequence from HRSV(A2)__P03418.1__N (opt1)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10233 - RNA, 1574 nt, synthetic construct
  misc_feature 1..1574: note = mRNA product Design c-2 comprising derived and/or modified sequence from HRSV(A2)__P03418.1__N (opt2)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10234 - RNA, 1574 nt, synthetic construct
  misc_feature 1..1574: note = mRNA product Design c-2 comprising derived and/or modified sequence from HRSV(A2)__P03418.1__N (opt3)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10235 - RNA, 1574 nt, synthetic construct
  misc_feature 1..1574: note = mRNA product Design c-2 comprising derived and/or modified sequence from HRSV(A2)__P03418.1__N (opt4)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10236 - RNA, 1574 nt, synthetic construct
  misc_feature 1..1574: note = mRNA product Design c-2 comprising derived and/or modified sequence from HRSV(A2)__P03418.1__N (opt5)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10237 - RNA, 1574 nt, synthetic construct
  misc_feature 1..1574: note = mRNA product Design c-2 comprising derived and/or modified sequence from HRSV(A2)__P03418.1__N (opt6)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10238 - RNA, 1574 nt, synthetic construct
  misc_feature 1..1574: note = mRNA product Design c-2 comprising derived and/or modified sequence from HRSV(A2)__P03418.1__N (opt11)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10239 - RNA, 1551 nt, synthetic construct
  misc_feature 1..1551: note = mRNA product Design c-3 comprising derived and/or modified sequence from HRSV(A2)__P03418.1__N (wt)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10240 - RNA, 1551 nt, synthetic construct
  misc_feature 1..1551: note = mRNA product Design c-3 comprising derived and/or modified sequence from HRSV(A2)__P03418.1__N (opt1)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10241 - RNA, 1551 nt, synthetic construct
  misc_feature 1..1551: note = mRNA product Design c-3 comprising derived and/or modified sequence from HRSV(A2)__P03418.1__N (opt2)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10242 - RNA, 1551 nt, synthetic construct
  misc_feature 1..1551: note = mRNA product Design c-3 comprising derived and/or modified sequence from HRSV(A2)__P03418.1__N (opt3)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10243 - RNA, 1551 nt, synthetic construct
  misc_feature 1..1551: note = mRNA product Design c-3 comprising derived and/or modified sequence from HRSV(A2)__P03418.1__N (opt4)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10244 - RNA, 1551 nt, synthetic construct
  misc_feature 1..1551: note = mRNA product Design c-3 comprising derived and/or modified sequence from HRSV(A2)__P03418.1__N (opt5)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10245 - RNA, 1551 nt, synthetic construct
  misc_feature 1..1551: note = mRNA product Design c-3 comprising derived and/or modified sequence from HRSV(A2)__P03418.1__N (opt6)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10246 - RNA, 1551 nt, synthetic construct
  misc_feature 1..1551: note = mRNA product Design c-3 comprising derived and/or modified sequence from HRSV(A2)__P03418.1__N (opt11)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10247 - RNA, 1547 nt, synthetic construct
  misc_feature 1..1547: note = mRNA product Design c-4 comprising derived and/or modified sequence from HRSV(A2)__P03418.1__N (wt)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10248 - RNA, 1547 nt, synthetic construct
  misc_feature 1..1547: note = mRNA product Design c-4 comprising derived and/or modified sequence from HRSV(A2)__P03418.1__N (opt1)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10249 - RNA, 1547 nt, synthetic construct
  misc_feature 1..1547: note = mRNA product Design c-4 comprising derived and/or modified sequence from HRSV(A2)__P03418.1__N (opt2)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10250 - RNA, 1547 nt, synthetic construct
  misc_feature 1..1547: note = mRNA product Design c-4 comprising derived and/or modified sequence from HRSV(A2)__P03418.1__N (opt3)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10251 - RNA, 1547 nt, synthetic construct
  misc_feature 1..1547: note = mRNA product Design c-4 comprising derived and/or modified sequence from HRSV(A2)__P03418.1__N (opt4)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10252 - RNA, 1547 nt, synthetic construct
  misc_feature 1..1547: note = mRNA product Design c-4 comprising derived and/or modified sequence from HRSV(A2)__P03418.1__N (opt5)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10253 - RNA, 1547 nt, synthetic construct
  misc_feature 1..1547: note = mRNA product Design c-4 comprising derived and/or modified sequence from HRSV(A2)__P03418.1__N (opt6)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10254 - RNA, 1547 nt, synthetic construct
  misc_feature 1..1547: note = mRNA product Design c-4 comprising derived and/or modified sequence from HRSV(A2)__P03418.1__N (opt11)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10255 - RNA, 1465 nt, synthetic construct
  misc_feature 1..1465: note = mRNA product Design c-5 comprising derived and/or modified sequence from HRSV(A2)__P03418.1__N (wt)
  source 1..1465: mol_type = other RNA
gggagagcggctcggccattttgtcccagtcagtccggaggctgcggctgcagaagtaccgcctgcggagtaactgcaaagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10256 - RNA, 1465 nt, synthetic construct
  misc_feature 1..1465: note = mRNA product Design c-5 comprising derived and/or modified sequence from HRSV(A2)__P03418.1__N (opt1)
  source 1..1465: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10257 - RNA, 1465 nt, synthetic construct
  misc_feature 1..1465: note = mRNA product Design c-5 comprising derived and/or modified sequence from HRSV(A2)__P03418.1__N (opt2)
  source 1..1465: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10258 - RNA, 1465 nt, synthetic construct
  misc_feature 1..1465: note = mRNA product Design c-5 comprising derived and/or modified sequence from HRSV(A2)__P03418.1__N (opt3)
  source 1..1465: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10259 - RNA, 1465 nt, synthetic construct
  misc_feature 1..1465: note = mRNA product Design c-5 comprising derived and/or modified sequence from HRSV(A2)__P03418.1__N (opt4)
  source 1..1465: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10260 - RNA, 1465 nt, synthetic construct
  misc_feature 1..1465: note = mRNA product Design c-5 comprising derived and/or modified sequence from HRSV(A2)__P03418.1__N (opt5)
  source 1..1465: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10261 - RNA, 1465 nt, synthetic construct
  misc_feature 1..1465: note = mRNA product Design c-5 comprising derived and/or modified sequence from HRSV(A2)__P03418.1__N (opt6)
  source 1..1465: mol_type = other RNA
gggagagcggctcggccattttgtcccagtcagtccggaggctgcggctgcagaagtaccgcctgcggagtaactgcaaagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10262 - RNA, 1465 nt, synthetic construct
  misc_feature 1..1465: note = mRNA product Design c-5 comprising derived and/or modified sequence from HRSV(A2)__P03418.1__N (opt11)
  source 1..1465: mol_type = other RNA
gggagagcggctcggccattttgtcccagtcagtccggaggctgcggctgcagaagtaccgcctgcggagtaactgcaaagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10263 - RNA, 1474 nt, synthetic construct
  misc_feature 1..1474: note = mRNA product Design d-1 comprising derived and/or modified sequence from HRSV(A2)__P03418.1__N (wt)
  source 1..1474: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10264 - RNA, 1474 nt, synthetic construct
  misc_feature 1..1474: note = mRNA product Design d-1 comprising derived and/or modified sequence from HRSV(A2)__P03418.1__N (opt1)
  source 1..1474: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10265 - RNA, 1474 nt, synthetic construct
  misc_feature 1..1474: note = mRNA product Design d-1 comprising derived and/or modified sequence from HRSV(A2)__P03418.1__N (opt2)
  source 1..1474: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10266 - RNA, 1474 nt, synthetic construct
  misc_feature 1..1474: note = mRNA product Design d-1 comprising derived and/or modified sequence from HRSV(A2)__P03418.1__N (opt3)
  source 1..1474: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10267 - RNA, 1474 nt, synthetic construct
  misc_feature 1..1474: note = mRNA product Design d-1 comprising derived and/or modified sequence from HRSV(A2)__P03418.1__N (opt4)
  source 1..1474: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10268 - RNA, 1474 nt, synthetic construct
  misc_feature 1..1474: note = mRNA product Design d-1 comprising derived and/or modified sequence from HRSV(A2)__P03418.1__N (opt5)
  source 1..1474: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10269 - RNA, 1474 nt, synthetic construct
  misc_feature 1..1474: note = mRNA product Design d-1 comprising derived and/or modified sequence from HRSV(A2)__P03418.1__N (opt6)
  source 1..1474: mol_type = other RNA
gggagacccgtgacccggaagttgtacggctacgcgactttccctcccacaaaccctcgcgcccttcctttcctacttgggcccggcagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10270 - RNA, 1474 nt, synthetic construct
  misc_feature 1..1474: note = mRNA product Design d-1 comprising derived and/or modified sequence from HRSV(A2)__P03418.1__N (opt11)
  source 1..1474: mol_type = other RNA
gggagacccgtgacccggaagttgtacggctacgcgactttccctcccacaaaccctcgcgcccttcctttcctacttgggcccggcagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10271 - RNA, 1529 nt, synthetic construct
  misc_feature 1..1529: note = mRNA product Design d-2 comprising derived and/or modified sequence from HRSV(A2)__P03418.1__N (wt)
  source 1..1529: mol_type = other RNA
gggagagcggctcggccattttgtcccagtcagtccggaggctgcggctgcagaagtaccgcctgcggagtaactgcaaagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10272 - RNA, 1529 nt, synthetic construct
  misc_feature 1..1529: note = mRNA product Design d-2 comprising derived and/or modified sequence from HRSV(A2)__P03418.1__N (opt1)
  source 1..1529: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10273 - RNA, 1529 nt, synthetic construct
  misc_feature 1..1529: note = mRNA product Design d-2 comprising derived and/or modified sequence from HRSV(A2)__P03418.1__N (opt2)
  source 1..1529: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10274 - RNA, 1529 nt, synthetic construct
  misc_feature 1..1529: note = mRNA product Design d-2 comprising derived and/or modified sequence from HRSV(A2)__P03418.1__N (opt3)
  source 1..1529: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10275 - RNA, 1529 nt, synthetic construct
  misc_feature 1..1529: note = mRNA product Design d-2 comprising derived and/or modified sequence from HRSV(A2)__P03418.1__N (opt4)
  source 1..1529: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10276 - RNA, 1529 nt, synthetic construct
  misc_feature 1..1529: note = mRNA product Design d-2 comprising derived and/or modified sequence from HRSV(A2)__P03418.1__N (opt5)
  source 1..1529: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10277 - RNA, 1529 nt, synthetic construct
  misc_feature 1..1529: note = mRNA product Design d-2 comprising derived and/or modified sequence from HRSV(A2)__P03418.1__N (opt6)
  source 1..1529: mol_type = other RNA
gggagagcggctcggccattttgtcccagtcagtccggaggctgcggctgcagaagtaccgcctgcggagtaactgcaaagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10278 - RNA, 1529 nt, synthetic construct
  misc_feature 1..1529: note = mRNA product Design d-2 comprising derived and/or modified sequence from HRSV(A2)__P03418.1__N (opt11)
  source 1..1529: mol_type = other RNA
gggagagcggctcggccattttgtcccagtcagtccggaggctgcggctgcagaagtaccgcctgcggagtaactgcaaagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10279 - RNA, 1845 nt, synthetic construct
  misc_feature 1..1845: note = mRNA product Design d-3 comprising derived and/or modified sequence from HRSV(A2)__P03418.1__N (wt)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10280 - RNA, 1845 nt, synthetic construct
  misc_feature 1..1845: note = mRNA product Design d-3 comprising derived and/or modified sequence from HRSV(A2)__P03418.1__N (opt1)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10281 - RNA, 1845 nt, synthetic construct
  misc_feature 1..1845: note = mRNA product Design d-3 comprising derived and/or modified sequence from HRSV(A2)__P03418.1__N (opt2)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10282 - RNA, 1845 nt, synthetic construct
  misc_feature 1..1845: note = mRNA product Design d-3 comprising derived and/or modified sequence from HRSV(A2)__P03418.1__N (opt3)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10283 - RNA, 1845 nt, synthetic construct
  misc_feature 1..1845: note = mRNA product Design d-3 comprising derived and/or modified sequence from HRSV(A2)__P03418.1__N (opt4)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10284 - RNA, 1845 nt, synthetic construct
  misc_feature 1..1845: note = mRNA product Design d-3 comprising derived and/or modified sequence from HRSV(A2)__P03418.1__N (opt5)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10285 - RNA, 1845 nt, synthetic construct
  misc_feature 1..1845: note = mRNA product Design d-3 comprising derived and/or modified sequence from HRSV(A2)__P03418.1__N (opt6)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10286 - RNA, 1845 nt, synthetic construct
  misc_feature 1..1845: note = mRNA product Design d-3 comprising derived and/or modified sequence from HRSV(A2)__P03418.1__N (opt11)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10287 - RNA, 1528 nt, synthetic construct
  misc_feature 1..1528: note = mRNA product Design d-4 comprising derived and/or modified sequence from HRSV(A2)__P03418.1__N (wt)
  source 1..1528: mol_type = other RNA
gggagagtcccgcagtcggcgtccagcggctctgcttgttcgtgtgtgtgtcgttgcaggccttattcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10288 - RNA, 1528 nt, synthetic construct
  misc_feature 1..1528: note = mRNA product Design d-4 comprising derived and/or modified sequence from HRSV(A2)__P03418.1__N (opt1)
  source 1..1528: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10289 - RNA, 1528 nt, synthetic construct
  misc_feature 1..1528: note = mRNA product Design d-4 comprising derived and/or modified sequence from HRSV(A2)__P03418.1__N (opt2)
  source 1..1528: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10290 - RNA, 1528 nt, synthetic construct
  misc_feature 1..1528: note = mRNA product Design d-4 comprising derived and/or modified sequence from HRSV(A2)__P03418.1__N (opt3)
  source 1..1528: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10291 - RNA, 1528 nt, synthetic construct
  misc_feature 1..1528: note = mRNA product Design d-4 comprising derived and/or modified sequence from HRSV(A2)__P03418.1__N (opt4)
  source 1..1528: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10292 - RNA, 1528 nt, synthetic construct
  misc_feature 1..1528: note = mRNA product Design d-4 comprising derived and/or modified sequence from HRSV(A2)__P03418.1__N (opt5)
  source 1..1528: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10293 - RNA, 1528 nt, synthetic construct
  misc_feature 1..1528: note = mRNA product Design d-4 comprising derived and/or modified sequence from HRSV(A2)__P03418.1__N (opt6)
  source 1..1528: mol_type = other RNA
gggagagtcccgcagtcggcgtccagcggctctgcttgttcgtgtgtgtgtcgttgcaggccttattcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10294 - RNA, 1528 nt, synthetic construct
  misc_feature 1..1528: note = mRNA product Design d-4 comprising derived and/or modified sequence from HRSV(A2)__P03418.1__N (opt11)
  source 1..1528: mol_type = other RNA
gggagagtcccgcagtcggcgtccagcggctctgcttgttcgtgtgtgtgtcgttgcaggccttattcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10295 - RNA, 1625 nt, synthetic construct
  misc_feature 1..1625: note = mRNA product Design d-5 comprising derived and/or modified sequence from HRSV(A2)__P03418.1__N (wt)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10296 - RNA, 1625 nt, synthetic construct
  misc_feature 1..1625: note = mRNA product Design d-5 comprising derived and/or modified sequence from HRSV(A2)__P03418.1__N (opt1)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10297 - RNA, 1625 nt, synthetic construct
  misc_feature 1..1625: note = mRNA product Design d-5 comprising derived and/or modified sequence from HRSV(A2)__P03418.1__N (opt2)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10298 - RNA, 1625 nt, synthetic construct
  misc_feature 1..1625: note = mRNA product Design d-5 comprising derived and/or modified sequence from HRSV(A2)__P03418.1__N (opt3)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10299 - RNA, 1625 nt, synthetic construct
  misc_feature 1..1625: note = mRNA product Design d-5 comprising derived and/or modified sequence from HRSV(A2)__P03418.1__N (opt4)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10300 - RNA, 1625 nt, synthetic construct
  misc_feature 1..1625: note = mRNA product Design d-5 comprising derived and/or modified sequence from HRSV(A2)__P03418.1__N (opt5)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10301 - RNA, 1625 nt, synthetic construct
  misc_feature 1..1625: note = mRNA product Design d-5 comprising derived and/or modified sequence from HRSV(A2)__P03418.1__N (opt6)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10302 - RNA, 1625 nt, synthetic construct
  misc_feature 1..1625: note = mRNA product Design d-5 comprising derived and/or modified sequence from HRSV(A2)__P03418.1__N (opt11)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10303 - RNA, 1505 nt, synthetic construct
  misc_feature 1..1505: note = mRNA product Design e-1 comprising derived and/or modified sequence from HRSV(A2)__P03418.1__N (wt)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10304 - RNA, 1505 nt, synthetic construct
  misc_feature 1..1505: note = mRNA product Design e-1 comprising derived and/or modified sequence from HRSV(A2)__P03418.1__N (opt1)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10305 - RNA, 1505 nt, synthetic construct
  misc_feature 1..1505: note = mRNA product Design e-1 comprising derived and/or modified sequence from HRSV(A2)__P03418.1__N (opt2)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10306 - RNA, 1505 nt, synthetic construct
  misc_feature 1..1505: note = mRNA product Design e-1 comprising derived and/or modified sequence from HRSV(A2)__P03418.1__N (opt3)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10307 - RNA, 1505 nt, synthetic construct
  misc_feature 1..1505: note = mRNA product Design e-1 comprising derived and/or modified sequence from HRSV(A2)__P03418.1__N (opt4)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10308 - RNA, 1505 nt, synthetic construct
  misc_feature 1..1505: note = mRNA product Design e-1 comprising derived and/or modified sequence from HRSV(A2)__P03418.1__N (opt5)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10309 - RNA, 1505 nt, synthetic construct
  misc_feature 1..1505: note = mRNA product Design e-1 comprising derived and/or modified sequence from HRSV(A2)__P03418.1__N (opt6)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10310 - RNA, 1505 nt, synthetic construct
  misc_feature 1..1505: note = mRNA product Design e-1 comprising derived and/or modified sequence from HRSV(A2)__P03418.1__N (opt11)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10311 - RNA, 1487 nt, synthetic construct
  misc_feature 1..1487: note = mRNA product Design e-2 comprising derived and/or modified sequence from HRSV(A2)__P03418.1__N (wt)
  source 1..1487: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10312 - RNA, 1487 nt, synthetic construct
  misc_feature 1..1487: note = mRNA product Design e-2 comprising derived and/or modified sequence from HRSV(A2)__P03418.1__N (opt1)
  source 1..1487: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10313 - RNA, 1487 nt, synthetic construct
  misc_feature 1..1487: note = mRNA product Design e-2 comprising derived and/or modified sequence from HRSV(A2)__P03418.1__N (opt2)
  source 1..1487: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10314 - RNA, 1487 nt, synthetic construct
  misc_feature 1..1487: note = mRNA product Design e-2 comprising derived and/or modified sequence from HRSV(A2)__P03418.1__N (opt3)
  source 1..1487: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10315 - RNA, 1487 nt, synthetic construct
  misc_feature 1..1487: note = mRNA product Design e-2 comprising derived and/or modified sequence from HRSV(A2)__P03418.1__N (opt4)
  source 1..1487: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10316 - RNA, 1487 nt, synthetic construct
  misc_feature 1..1487: note = mRNA product Design e-2 comprising derived and/or modified sequence from HRSV(A2)__P03418.1__N (opt5)
  source 1..1487: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10317 - RNA, 1487 nt, synthetic construct
  misc_feature 1..1487: note = mRNA product Design e-2 comprising derived and/or modified sequence from HRSV(A2)__P03418.1__N (opt6)
  source 1..1487: mol_type = other RNA
gggagacccgtgacccggaagttgtacggctacgcgactttccctcccacaaaccctcgcgcccttcctttcctacttgggcccggcagaaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10318 - RNA, 1487 nt, synthetic construct
  misc_feature 1..1487: note = mRNA product Design e-2 comprising derived and/or modified sequence from HRSV(A2)__P03418.1__N (opt11)
  source 1..1487: mol_type = other RNA
gggagacccgtgacccggaagttgtacggctacgcgactttccctcccacaaaccctcgcgcccttcctttcctacttgggcccggcagaaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10319 - RNA, 1457 nt, synthetic construct
  misc_feature 1..1457: note = mRNA product Design e-3 comprising derived and/or modified sequence from HRSV(A2)__P03418.1__N (wt)
  source 1..1457: mol_type = other RNA
gggagactttcccattctgtagcagaatttggtgttgcctgtggtcttggtcccgcggagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10320 - RNA, 1457 nt, synthetic construct
  misc_feature 1..1457: note = mRNA product Design e-3 comprising derived and/or modified sequence from HRSV(A2)__P03418.1__N (opt1)
  source 1..1457: mol_type = other RNA
gggagactttcccattctgtagcagaatttggtgttgcctgtggtcttggtcccgcggagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10321 - RNA, 1457 nt, synthetic construct
  misc_feature 1..1457: note = mRNA product Design e-3 comprising derived and/or modified sequence from HRSV(A2)__P03418.1__N (opt2)
  source 1..1457: mol_type = other RNA
gggagactttcccattctgtagcagaatttggtgttgcctgtggtcttggtcccgcggagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10322 - RNA, 1457 nt, synthetic construct
  misc_feature 1..1457: note = mRNA product Design e-3 comprising derived and/or modified sequence from HRSV(A2)__P03418.1__N (opt3)
  source 1..1457: mol_type = other RNA
gggagactttcccattctgtagcagaatttggtgttgcctgtggtcttggtcccgcggagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10323 - RNA, 1457 nt, synthetic construct
  misc_feature 1..1457: note = mRNA product Design e-3 comprising derived and/or modified sequence from HRSV(A2)__P03418.1__N (opt4)
  source 1..1457: mol_type = other RNA
gggagactttcccattctgtagcagaatttggtgttgcctgtggtcttggtcccgcggagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10324 - RNA, 1457 nt, synthetic construct
  misc_feature 1..1457: note = mRNA product Design e-3 comprising derived and/or modified sequence from HRSV(A2)__P03418.1__N (opt5)
  source 1..1457: mol_type = other RNA
gggagactttcccattctgtagcagaatttggtgttgcctgtggtcttggtcccgcggagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10325 - RNA, 1457 nt, synthetic construct
  misc_feature 1..1457: note = mRNA product Design e-3 comprising derived and/or modified sequence from HRSV(A2)__P03418.1__N (opt6)
  source 1..1457: mol_type = other RNA
gggagactttcccattctgtagcagaatttggtgttgcctgtggtcttggtcccgcggagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10326 - RNA, 1457 nt, synthetic construct
  misc_feature 1..1457: note = mRNA product Design e-3 comprising derived and/or modified sequence from HRSV(A2)__P03418.1__N (opt11)
  source 1..1457: mol_type = other RNA
gggagactttcccattctgtagcagaatttggtgttgcctgtggtcttggtcccgcggagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10327 - RNA, 1511 nt, synthetic construct
  misc_feature 1..1511: note = mRNA product Design e-4 comprising derived and/or modified sequence from HRSV(A2)__P03418.1__N (wt)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10328 - RNA, 1511 nt, synthetic construct
  misc_feature 1..1511: note = mRNA product Design e-4 comprising derived and/or modified sequence from HRSV(A2)__P03418.1__N (opt1)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10329 - RNA, 1511 nt, synthetic construct
  misc_feature 1..1511: note = mRNA product Design e-4 comprising derived and/or modified sequence from HRSV(A2)__P03418.1__N (opt2)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10330 - RNA, 1511 nt, synthetic construct
  misc_feature 1..1511: note = mRNA product Design e-4 comprising derived and/or modified sequence from HRSV(A2)__P03418.1__N (opt3)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10331 - RNA, 1511 nt, synthetic construct
  misc_feature 1..1511: note = mRNA product Design e-4 comprising derived and/or modified sequence from HRSV(A2)__P03418.1__N (opt4)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10332 - RNA, 1511 nt, synthetic construct
  misc_feature 1..1511: note = mRNA product Design e-4 comprising derived and/or modified sequence from HRSV(A2)__P03418.1__N (opt5)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10333 - RNA, 1511 nt, synthetic construct
  misc_feature 1..1511: note = mRNA product Design e-4 comprising derived and/or modified sequence from HRSV(A2)__P03418.1__N (opt6)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10334 - RNA, 1511 nt, synthetic construct
  misc_feature 1..1511: note = mRNA product Design e-4 comprising derived and/or modified sequence from HRSV(A2)__P03418.1__N (opt11)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10335 - RNA, 1478 nt, synthetic construct
  misc_feature 1..1478: note = mRNA product Design e-5 comprising derived and/or modified sequence from HRSV(A2)__P03418.1__N (wt)
  source 1..1478: mol_type = other RNA
gggagagcggctcggccattttgtcccagtcagtccggaggctgcggctgcagaagtaccgcctgcggagtaactgcaaagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10336 - RNA, 1478 nt, synthetic construct
  misc_feature 1..1478: note = mRNA product Design e-5 comprising derived and/or modified sequence from HRSV(A2)__P03418.1__N (opt1)
  source 1..1478: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10337 - RNA, 1478 nt, synthetic construct
  misc_feature 1..1478: note = mRNA product Design e-5 comprising derived and/or modified sequence from HRSV(A2)__P03418.1__N (opt2)
  source 1..1478: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10338 - RNA, 1478 nt, synthetic construct
  misc_feature 1..1478: note = mRNA product Design e-5 comprising derived and/or modified sequence from HRSV(A2)__P03418.1__N (opt3)
  source 1..1478: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10339 - RNA, 1478 nt, synthetic construct
  misc_feature 1..1478: note = mRNA product Design e-5 comprising derived and/or modified sequence from HRSV(A2)__P03418.1__N (opt4)
  source 1..1478: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10340 - RNA, 1478 nt, synthetic construct
  misc_feature 1..1478: note = mRNA product Design e-5 comprising derived and/or modified sequence from HRSV(A2)__P03418.1__N (opt5)
  source 1..1478: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10341 - RNA, 1478 nt, synthetic construct
  misc_feature 1..1478: note = mRNA product Design e-5 comprising derived and/or modified sequence from HRSV(A2)__P03418.1__N (opt6)
  source 1..1478: mol_type = other RNA
gggagagcggctcggccattttgtcccagtcagtccggaggctgcggctgcagaagtaccgcctgcggagtaactgcaaagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10342 - RNA, 1478 nt, synthetic construct
  misc_feature 1..1478: note = mRNA product Design e-5 comprising derived and/or modified sequence from HRSV(A2)__P03418.1__N (opt11)
  source 1..1478: mol_type = other RNA
gggagagcggctcggccattttgtcccagtcagtccggaggctgcggctgcagaagtaccgcctgcggagtaactgcaaagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10343 - RNA, 1545 nt, synthetic construct
  misc_feature 1..1545: note = mRNA product Design e-6 comprising derived and/or modified sequence from HRSV(A2)__P03418.1__N (wt)
  source 1..1545: mol_type = other RNA
gggagagcggctcggccattttgtcccagtcagtccggaggctgcggctgcagaagtaccgcctgcggagtaactgcaaagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10344 - RNA, 1545 nt, synthetic construct
  misc_feature 1..1545: note = mRNA product Design e-6 comprising derived and/or modified sequence from HRSV(A2)__P03418.1__N (opt1)
  source 1..1545: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10345 - RNA, 1545 nt, synthetic construct
  misc_feature 1..1545: note = mRNA product Design e-6 comprising derived and/or modified sequence from HRSV(A2)__P03418.1__N (opt2)
  source 1..1545: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10346 - RNA, 1545 nt, synthetic construct
  misc_feature 1..1545: note = mRNA product Design e-6 comprising derived and/or modified sequence from HRSV(A2)__P03418.1__N (opt3)
  source 1..1545: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10347 - RNA, 1545 nt, synthetic construct
  misc_feature 1..1545: note = mRNA product Design e-6 comprising derived and/or modified sequence from HRSV(A2)__P03418.1__N (opt4)
  source 1..1545: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10348 - RNA, 1545 nt, synthetic construct
  misc_feature 1..1545: note = mRNA product Design e-6 comprising derived and/or modified sequence from HRSV(A2)__P03418.1__N (opt5)
  source 1..1545: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10349 - RNA, 1545 nt, synthetic construct
  misc_feature 1..1545: note = mRNA product Design e-6 comprising derived and/or modified sequence from HRSV(A2)__P03418.1__N (opt6)
  source 1..1545: mol_type = other RNA
gggagagcggctcggccattttgtcccagtcagtccggaggctgcggctgcagaagtaccgcctgcggagtaactgcaaagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10350 - RNA, 1545 nt, synthetic construct
  misc_feature 1..1545: note = mRNA product Design e-6 comprising derived and/or modified sequence from HRSV(A2)__P03418.1__N (opt11)
  source 1..1545: mol_type = other RNA
gggagagcggctcggccattttgtcccagtcagtccggaggctgcggctgcagaagtaccgcctgcggagtaactgcaaagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10351 - RNA, 1761 nt, synthetic construct
  misc_feature 1..1761: note = mRNA product Design f-1 comprising derived and/or modified sequence from HRSV(A2)__P03418.1__N (wt)
  source 1..1761: mol_type = other RNA
gggagagcggctcggccattttgtcccagtcagtccggaggctgcggctgcagaagtaccgcctgcggagtaactgcaaagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10352 - RNA, 1761 nt, synthetic construct
  misc_feature 1..1761: note = mRNA product Design f-1 comprising derived and/or modified sequence from HRSV(A2)__P03418.1__N (opt1)
  source 1..1761: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10353 - RNA, 1761 nt, synthetic construct
  misc_feature 1..1761: note = mRNA product Design f-1 comprising derived and/or modified sequence from HRSV(A2)__P03418.1__N (opt2)
  source 1..1761: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10354 - RNA, 1761 nt, synthetic construct
  misc_feature 1..1761: note = mRNA product Design f-1 comprising derived and/or modified sequence from HRSV(A2)__P03418.1__N (opt3)
  source 1..1761: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10355 - RNA, 1761 nt, synthetic construct
  misc_feature 1..1761: note = mRNA product Design f-1 comprising derived and/or modified sequence from HRSV(A2)__P03418.1__N (opt4)
  source 1..1761: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10356 - RNA, 1761 nt, synthetic construct
  misc_feature 1..1761: note = mRNA product Design f-1 comprising derived and/or modified sequence from HRSV(A2)__P03418.1__N (opt5)
  source 1..1761: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10357 - RNA, 1761 nt, synthetic construct
  misc_feature 1..1761: note = mRNA product Design f-1 comprising derived and/or modified sequence from HRSV(A2)__P03418.1__N (opt6)
  source 1..1761: mol_type = other RNA
gggagagcggctcggccattttgtcccagtcagtccggaggctgcggctgcagaagtaccgcctgcggagtaactgcaaagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10358 - RNA, 1761 nt, synthetic construct
  misc_feature 1..1761: note = mRNA product Design f-1 comprising derived and/or modified sequence from HRSV(A2)__P03418.1__N (opt11)
  source 1..1761: mol_type = other RNA
gggagagcggctcggccattttgtcccagtcagtccggaggctgcggctgcagaagtaccgcctgcggagtaactgcaaagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10359 - RNA, 1541 nt, synthetic construct
  misc_feature 1..1541: note = mRNA product Design f-2 comprising derived and/or modified sequence from HRSV(A2)__P03418.1__N (wt)
  source 1..1541: mol_type = other RNA
gggagagcggctcggccattttgtcccagtcagtccggaggctgcggctgcagaagtaccgcctgcggagtaactgcaaagaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10360 - RNA, 1541 nt, synthetic construct
  misc_feature 1..1541: note = mRNA product Design f-2 comprising derived and/or modified sequence from HRSV(A2)__P03418.1__N (opt1)
  source 1..1541: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10361 - RNA, 1541 nt, synthetic construct
  misc_feature 1..1541: note = mRNA product Design f-2 comprising derived and/or modified sequence from HRSV(A2)__P03418.1__N (opt2)
  source 1..1541: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10362 - RNA, 1541 nt, synthetic construct
  misc_feature 1..1541: note = mRNA product Design f-2 comprising derived and/or modified sequence from HRSV(A2)__P03418.1__N (opt3)
  source 1..1541: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10363 - RNA, 1541 nt, synthetic construct
  misc_feature 1..1541: note = mRNA product Design f-2 comprising derived and/or modified sequence from HRSV(A2)__P03418.1__N (opt4)
  source 1..1541: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10364 - RNA, 1541 nt, synthetic construct
  misc_feature 1..1541: note = mRNA product Design f-2 comprising derived and/or modified sequence from HRSV(A2)__P03418.1__N (opt5)
  source 1..1541: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggactgatcggcatgctctacgccatgagccggctggggcgcgaagacacaattaagatcctgagagatgcgggatatcacgttaaagctaatggcgtggacgtgaccacacatcggcaggatatcaacgggaaggagatgaaatttgaagtcctcaccctggcctcccttacgaccgagattcagatcaatattgaaatcgagtctcgcaagagctacaaaaagatgctgaaggagatgggagaagtggcccctgagtatagacacgactccccggattgtggcatgattatcctctgcattgctgccctggttatcacaaaacttgctgccggcgaccggagcgggctgaccgcggtgatccgcagagccaacaatgtcctcaagaacgaaatgaaacggtacaagggactgctgcccaaagatattgctaattctttctatgaggtgtttgagaagcatcctcacttcatcgacgtttttgtgcacttcggcattgcccaatccagcacacgcgggggatctagagtcgaaggcatctttgctggactcttcatgaacgcctacggggcgggccaggtgatgctgcggtggggcgtgcttgccaaatccgtcaagaatattatgctggggcatgctagcgttcaggccgagatggaacaggtggtggaggtctacgaatatgctcaaaagctcggaggcgaggccgggttttaccacatcctgaacaatcccaaagcctctcttctgtccctcacccagttccctcattttagctccgtggttctgggaaacgctgcgggcctggggatcatgggagagtatcgcggcacgcccagaaaccaggacctctacgatgccgctaaggcctatgccgaacagctgaaagagaatggcgtgattaactactctgtccttgacctgacagctgaggaactcgaagccatcaagcaccaactgaatcctaaagataacgacgtggagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10365 - RNA, 1541 nt, synthetic construct
  misc_feature 1..1541: note = mRNA product Design f-2 comprising derived and/or modified sequence from HRSV(A2)__P03418.1__N (opt6)
  source 1..1541: mol_type = other RNA
gggagagcggctcggccattttgtcccagtcagtccggaggctgcggctgcagaagtaccgcctgcggagtaactgcaaagaagcttaccatggcactaagcaaagtcaaattaaacgacacattaaacaaagaccaactcttatcatcatcaaaatacacaatacaaagaagcaccggagacagtatcgacacaccaaactatgacgtccaaaaacatataaataaattatgcggcatgctcttaatcacagaagacgccaaccataaatttacaggattaataggaatgttatatgcaatgtcacgactaggtagagaagacacaataaaaatactaagagacgcaggctatcacgtaaaagcaaatggagtagacgtaaccacacacagacaagacataaatggaaaagaaatgaaatttgaagtattaacactagcatcactaacaacagaaatacaaatcaacatagaaatagaatcaagaaaaagctacaaaaaaatgttaaaagaaatgggagaagtcgcaccagaatatagacatgattcaccagactgcggaatgataatactatgcatagcagccctagtaattacaaaactagcagcaggagacagaagcggattaacagcagtaataagaagagcaaacaacgtactaaaaaacgaaatgaaaagatataaaggattattaccaaaagacatagcaaactcattctatgaagtattcgaaaaacacccccactttatagacgtcttcgtacacttcggaatagcccaatcatccacaagaggaggatcaagagtcgaaggaatattcgcaggattattcatgaacgcatatggcgcaggacaagtaatgctaagatggggagtactagcaaaatccgtcaaaaacataatgctaggacacgcatcagttcaagcagaaatggaacaagtagtagaagtatacgaatacgcccaaaaactaggaggagaagcaggattctaccacatactaaataatccaaaagcatcactactaagcctaacccaatttccccacttctcaagtgtagtattaggaaatgcagctggactaggaataatgggagaatacagaggaacaccaagaaaccaagacttatacgacgcagcaaaagcatacgcagagcaacttaaagaaaacggagtaataaactatagcgtactagacttaacagcagaagaactggaagcaataaaacatcaattaaacccgaaagacaatgacgtagaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10366 - RNA, 1541 nt, synthetic construct
  misc_feature 1..1541: note = mRNA product Design f-2 comprising derived and/or modified sequence from HRSV(A2)__P03418.1__N (opt11)
  source 1..1541: mol_type = other RNA
gggagagcggctcggccattttgtcccagtcagtccggaggctgcggctgcagaagtaccgcctgcggagtaactgcaaagaagcttaccatggcactctcgaaagtaaaactcaacgacaccctcaacaaagaccaactcctttccagctccaaatacaccatccaacgatccaccggagactccatcgacacgcccaactacgacgtccagaaacacatcaacaagctctgcggaatgctactaatcaccgaggacgccaaccacaaattcacaggacttatagggatgctctacgccatgtcccgcctcggacgcgaagacacaataaaaatcctacgagacgccggctaccacgtaaaggcaaacggcgtcgacgtcaccacacacagacaagacatcaacggaaaggaaatgaaattcgaagtcctcaccctcgccagcctaaccaccgagatccaaatcaacatcgaaatcgaatcacgcaaatcctacaagaaaatgctcaaagaaatgggagaagtcgcccccgaataccgtcacgactcgcccgactgcggcatgataatcctatgcatcgccgcactcgtcataaccaaactcgccgccggtgaccgatcaggactgacagcagtcatccgccgagcaaacaacgtgctcaaaaacgaaatgaaacgctacaaaggcctactccccaaagacatcgccaactccttctacgaagtcttcgaaaaacacccacacttcatcgacgtcttcgtccacttcggcatcgcacaatcatcaaccagaggcggcagccgcgttgaaggcatcttcgcaggactctttatgaacgcctacggcgccggccaagtcatgctccgctggggcgtcctggcaaaaagcgtcaaaaacatcatgctaggccacgctagcgtccaagccgaaatggaacaagtcgtcgaagtttacgagtacgcacaaaaactcggcggcgaagcaggcttctaccacatcctaaacaaccccaaagcctccctgctatcactcacccaattcccccacttctccagcgtcgtcctcggcaacgccgcaggactaggcatcatgggagaataccgcgggacaccgcgcaaccaagacctctacgacgccgccaaagcctacgccgaacaactcaaagaaaacggcgtcataaactactcagtcctcgacctcaccgccgaagaactcgaagccatcaaacaccaactcaacccaaaagacaacgacgtcgaattataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10367 - RNA, 1532 nt, synthetic construct
  misc_feature 1..1532: note = mRNA product Design f-3 comprising derived and/or modified sequence from HRSV(A2)__P03418.1__N (wt)
  source 1..1532: mol_type = other RNA
gggagagtcccgcagtcggcgtccagcggctctgcttgttcgtgtgtgtgtcgttgcaggccttattcaagcttaccatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10368 - RNA, 1532 nt, synthetic construct
  misc_feature 1..1532: note = mRNA product Design f-3 comprising derived and/or modified sequence from HRSV(A2)__P03418.1__N (opt1)
  source 1..1532: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcctgatcgggatgctgtacgcgatgagccggctcggccgcgaggacacgatcaagatcctgcgggacgccgggtaccacgtgaaggccaacggcgtggacgtcaccacccaccgccaggacatcaacggcaaggagatgaagttcgaggtgctgaccctcgcctccctgacgaccgagatccagatcaacatcgagatcgagagccggaagtcctacaagaagatgctgaaggagatgggggaggtggccccggagtaccgccacgacagccccgactgcggcatgatcatcctctgcatcgcggccctggtcatcaccaagctggccgccggggaccggtccggcctcaccgcggtgatccgccgggccaacaacgtgctgaagaacgagatgaagcgctacaaggggctgctccccaaggacatcgccaacagcttctacgaggtcttcgagaagcacccccacttcatcgacgtgttcgtgcacttcggcatcgcccagtccagcacgcggggcgggtcccgcgtcgagggcatcttcgccgggctgttcatgaacgcgtacggcgccggccaggtgatgctgcggtggggcgtgctcgccaagagcgtcaagaacatcatgctggggcacgcctccgtgcaggccgagatggagcaggtcgtggaggtgtacgagtacgcgcagaagctcgggggcgaggccgggttctaccacatcctgaacaacccgaaggccagcctgctgtccctcacccagttcccccacttcagcagcgtggtcctgggcaacgccgccggcctggggatcatgggcgagtaccgcgggacgccccggaaccaggacctctacgacgcggccaaggcctacgccgagcagctgaaggagaacggcgtgatcaactactccgtgctggacctcaccgccgaggagctggaggcgatcaagcaccagctgaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10369 - RNA, 1532 nt, synthetic construct
  misc_feature 1..1532: note = mRNA product Design f-3 comprising derived and/or modified sequence from HRSV(A2)__P03418.1__N (opt2)
  source 1..1532: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcctcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagcacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10370 - RNA, 1532 nt, synthetic construct
  misc_feature 1..1532: note = mRNA product Design f-3 comprising derived and/or modified sequence from HRSV(A2)__P03418.1__N (opt3)
  source 1..1532: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggactcattggtatgctgtacgcaatgtccaggcttggccgggaagacactatcaagattctgcgcgatgccgggtatcacgttaaagcgaatggagtggacgtaaccacacatcgacaggatatcaacggcaaggagatgaaatttgaagtgttgaccctcgcttctctgactacagagatacagatcaatattgaaatcgagtcgcgtaagtcatacaaaaagatgctgaaggagatgggtgaagtcgcccctgagtatagacacgacagcccagattgtgggatgattatcctctgcatagcagccttagtgattaccaaactggctgcaggagacaggagtggccttacggccgttatccggcgcgctaacaatgtgttgaagaacgaaatgaaaagatacaagggcctgctaccgaaagatattgccaattccttctatgaggtctttgagaagcatccccacttcatcgacgtgtttgtacacttcgggatcgcgcaatctagcactaggggaggttcccgggttgaaggcatttttgcaggactcttcatgaacgcctacggggctggccaggtgatgctgcgctggggtgtccttgccaaatcagtgaagaatataatgctggggcatgcaagtgtgcaggctgagatggaacaggtcgttgaggtgtacgaatatgcccaaaagttgggaggcgaggcgggcttttaccacatcctcaacaatcctaaagccagcctgttatctctgacccagttcccacatttttcctcagtagtgctcgggaacgcagctggacttggtattatgggcgagtatcgagggacacccagaaaccaggacctgtacgatgccgctaaggcctatgcagaacagttgaaagagaatggagtcatcaactacagcgtgctagacctgactgccgaggaactcgaagctataaagcaccaactgaatcctaaagataacgacgttgagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10371 - RNA, 1532 nt, synthetic construct
  misc_feature 1..1532: note = mRNA product Design f-3 comprising derived and/or modified sequence from HRSV(A2)__P03418.1__N (opt4)
  source 1..1532: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcctgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagcacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
